United States Patent
Peters et al.

(10) Patent No.: US 11,505,836 B2
(45) Date of Patent: *Nov. 22, 2022

(54) COMPOSITIONS AND METHODS FOR ENHANCING AND/OR PREDICTING DNA AMPLIFICATION

(71) Applicant: ENVIROLOGIX INC., Portland, ME (US)

(72) Inventors: Lars Peters, Portland, ME (US); Stephen A. Judice, Portland, ME (US); Daniel Shaffer, Portland, ME (US); Breck Parker, Portland, ME (US)

(73) Assignee: ENVIROLOGIX INC., Portland, ME (US)

( * ) Notice: Subject to any disclaimer, the term of this patent is extended or adjusted under 35 U.S.C. 154(b) by 141 days.

This patent is subject to a terminal disclaimer.

(21) Appl. No.: 15/306,032

(22) PCT Filed: Apr. 22, 2015

(86) PCT No.: PCT/US2015/027074
§ 371 (c)(1),
(2) Date: Oct. 21, 2016

(87) PCT Pub. No.: WO2015/164494
PCT Pub. Date: Oct. 29, 2015

(65) Prior Publication Data
US 2017/0044628 A1 Feb. 16, 2017

Related U.S. Application Data

(60) Provisional application No. 61/982,784, filed on Apr. 22, 2014.

(51) Int. Cl.
| | | |
|---|---|---|
| *C12Q 1/68* | (2018.01) | |
| *C12Q 1/6895* | (2018.01) | |
| *C07H 21/04* | (2006.01) | |
| *C12Q 1/6876* | (2018.01) | |
| *C12Q 1/6844* | (2018.01) | |
| *C12Q 1/6853* | (2018.01) | |

(52) U.S. Cl.
CPC .......... *C12Q 1/6895* (2013.01); *C07H 21/04* (2013.01); *C12Q 1/6844* (2013.01); *C12Q 1/6853* (2013.01); *C12Q 1/6876* (2013.01); *C12Q 2600/156* (2013.01)

(58) Field of Classification Search
None
See application file for complete search history.

(56) References Cited

U.S. PATENT DOCUMENTS

| | | | |
|---|---|---|---|
| 5,455,166 A | 10/1995 | Walker | |
| 5,629,179 A * | 5/1997 | Mierendorf | C12N 15/1096 435/91.2 |
| 5,952,202 A | 9/1999 | Aoyagi et al. | |
| 6,063,604 A | 5/2000 | Wick et al. | |
| 6,130,038 A | 10/2000 | Becker et al. | |
| 6,355,421 B1 | 3/2002 | Coull et al. | |
| 6,617,137 B2 | 9/2003 | Dean et al. | |
| 6,794,142 B2 | 9/2004 | Laird et al. | |
| 6,977,148 B2 | 12/2005 | Dean et al. | |
| 7,056,671 B2 | 6/2006 | Enoki et al. | |
| 7,074,600 B2 | 7/2006 | Dean et al. | |
| 7,094,539 B2 | 8/2006 | Gu et al. | |
| 7,112,423 B2 | 9/2006 | Van Ness et al. | |
| 7,282,328 B2 | 10/2007 | Kong et al. | |
| 7,662,594 B2 | 2/2010 | Kong et al. | |
| 8,574,847 B2 | 11/2013 | Becker et al. | |
| 9,096,897 B2 | 8/2015 | Shaffer et al. | |
| 9,322,053 B2 | 4/2016 | Shaffer et al. | |
| 9,631,231 B2 | 4/2017 | Shaffer et al. | |
| 9,845,510 B2 * | 12/2017 | Peters | C12Q 1/689 |
| 10,077,467 B2 | 9/2018 | Shaffer et al. | |
| 10,100,370 B2 * | 10/2018 | Parker | C12Q 1/689 |
| 10,584,376 B2 | 3/2020 | Shaffer et al. | |
| 10,793,922 B2 * | 10/2020 | Peters | C12Q 1/701 |
| 2003/0060431 A1 | 3/2003 | Simmonds et al. | |
| 2003/0211483 A1 | 11/2003 | Schroeder et al. | |
| 2005/0059003 A1 | 3/2005 | Enoki et al. | |
| 2006/0115838 A1 | 6/2006 | Bazar et al. | |
| 2006/0216796 A1 * | 9/2006 | Hashiguchi | C12N 15/52 435/106 |
| 2007/0054296 A1 | 3/2007 | Piepenburg et al. | |
| 2007/0082011 A1 | 4/2007 | Lehrer et al. | |
| 2008/0254458 A1 | 10/2008 | Chou | |
| 2008/0274458 A1 | 11/2008 | Latham et al. | |
| 2009/0017452 A1 | 1/2009 | Ratain et al. | |

(Continued)

FOREIGN PATENT DOCUMENTS

| | | |
|---|---|---|
| CN | 1633505 A | 6/2005 |
| CN | 101952459 A | 1/2011 |

(Continued)

OTHER PUBLICATIONS

Stratagene Catalog, gene characterization kits. Stratagene Catalog, p. 39, 1988.*
International Search Report and Written Opinion for corresponding PCT/US2015/027074, dated Sep. 8, 2015 (13 pages).
Translation of office action received in corresponding Russian application No. 2016145402/10(072953), (3 pages).
Office Action from corresponding European application No. 15783300.5, dated Jan. 29, 2019 (4 pages).
Translation of office action received in corresponding Japanese application No. 2016-563818, dated Mar. 5, 2019 (4 pages).
Thornton B., Basu C. "Real-time PCR (qPCR) Primer Design Using Free Online Software," Biochemistry and Molecular Biology Education, 2011, vol. 39, No. 2, pp. 145-154.
Translation of office action received in corresponding Russian application No. 2016145402/10(072953), (4 pages).

(Continued)

*Primary Examiner* — Suryaprabha Chunduru
(74) *Attorney, Agent, or Firm* — Melissa Hunter-Ensor; Nicholas R. Ballor; Greenberg Traurig, LLP

(57) ABSTRACT

The present invention features compositions and methods for amplifying a target oligonucleotide in a sample, including detection of the target oligonucleotide in real time.

17 Claims, 35 Drawing Sheets

Specification includes a Sequence Listing.

(56) References Cited

U.S. PATENT DOCUMENTS

| | | | |
|---|---|---|---|
| 2009/0017453 A1 | 1/2009 | Maples et al. | |
| 2009/0048439 A1 | 2/2009 | Weisburg et al. | |
| 2009/0081670 A1 | 3/2009 | Maples et al. | |
| 2009/0197254 A1 | 8/2009 | Lee | |
| 2010/0092957 A1* | 4/2010 | Zhao | C07H 19/04 435/6.13 |
| 2010/0099149 A1 | 4/2010 | Birnboim et al. | |
| 2010/0255546 A1 | 10/2010 | Uematsu et al. | |
| 2011/0081685 A1* | 4/2011 | Makarov | C12P 19/34 435/91.2 |
| 2011/0151467 A1 | 6/2011 | Usui et al. | |
| 2012/0021461 A1 | 1/2012 | Millar et al. | |
| 2013/0217071 A1 | 8/2013 | Montesclaros et al. | |
| 2013/0280706 A1 | 10/2013 | Judice | |
| 2014/0093883 A1 | 4/2014 | Maples et al. | |
| 2017/0166960 A1 | 6/2017 | Shaffer et al. | |
| 2017/0327911 A1 | 11/2017 | Peters et al. | |
| 2018/0363046 A1 | 12/2018 | Shaffer et al. | |
| 2020/0239947 A1 | 7/2020 | Shaffer et al. | |
| 2021/0025016 A1 | 1/2021 | Peters et al. | |

FOREIGN PATENT DOCUMENTS

| | | | | |
|---|---|---|---|---|
| EP | 1201768 | A2 | 5/2002 | |
| EP | 1420069 | A1 | 5/2004 | |
| EP | 2836609 | A1 | 2/2015 | |
| JP | 2002291490 | A | 10/2002 | |
| JP | 2004532615 | A | 10/2004 | |
| JP | 2008526228 | A | 7/2008 | |
| JP | 2010505396 | A | 2/2010 | |
| JP | 2010533494 | A | 10/2010 | |
| JP | 2011521624 | A | 7/2011 | |
| JP | 2014082936 | A | 5/2014 | |
| KR | 20040028991 | A | 4/2004 | |
| WO | 2002057479 | A2 | 7/2002 | |
| WO | 2003008622 | A2 | 1/2003 | |
| WO | 2003016569 | A1 | 2/2003 | |
| WO | 2006074162 | A2 | 7/2006 | |
| WO | 2008002920 | A2 | 1/2008 | |
| WO | 2008040126 | A1 | 4/2008 | |
| WO | 2009012246 | A2 | 1/2009 | |
| WO | 2009135093 | A2 | 11/2009 | |
| WO | 2010/107946 | A2 | 9/2010 | |
| WO | 2012021493 | A2 | 2/2012 | |
| WO | 2012022755 | A1 | 2/2012 | |
| WO | WO-2012021493 | A2 * | 2/2012 | C12Q 1/6851 |
| WO | 2013040491 | A2 | 3/2013 | |
| WO | 2013155056 | A1 | 10/2013 | |
| WO | 2014004852 | A2 | 1/2014 | |
| WO | 2015168134 | A1 | 11/2015 | |
| WO | 2016064894 | A2 | 4/2016 | |
| WO | 2016/069345 | A1 | 5/2016 | |
| WO | 2016122698 | A1 | 8/2016 | |

OTHER PUBLICATIONS

Translation of Search Report received in corresponding Russian application No. 2016145402/10(072953), (2 pages).
Office Action for corresponding Mexican Patent Application No. MX/a/2016/013877, dated Sep. 10, 2019 (4 pages).
English Translation of Office Action for corresponding Mexican Patent Application No. MX/a/2016/013877, dated Sep. 10, 2019 (4 pages).
Examination Report in corresponding Indian Patent Application No. 201617039196, dated Feb. 24, 2020 (7 pages).
Office Action in corresponding Mexican Patent Application No. MX/a/2016/013877, dated Feb. 25, 2020 (4 pages).
English Explanation of the Office Action in corresponding Mexican Patent Application No. MX/a/2016/013877, dated Feb. 25, 2020 (4 pages).
Office Action in corresponding Brazilian Patent Application No. BR112016024622-5, dated Nov. 19, 2019 (4 pages).
English explanation of Office Action in corresponding Brazilian Patent Application No. BR112016024622-5, dated Nov. 19, 2019.
Office Action for corresponding Chinese Patent Application No. 201580033738.0, dated Nov. 4, 2019 (11 pages).
English Translation of Office Action for corresponding Chinese Patent Application No. 201580033738.0, dated Nov. 4, 2019 (11 pages).
Office Action in corresponding Ukrainian Patent Application No. a201611679, dated Jan. 17, 2020 (3 pages).
English translation of Office Action in corresponding Ukrainian Patent Application No. a201611679, dated Jan. 17, 2020 (2 pages).
Second Office Action received in corresponding Chinese Patent Application No. 201580033738.0, dated Sep. 1, 2020 (3 pages).
English translation of the Second Office Action received in corresponding Chinese Patent Application No. 2015800337380, dated Sep. 1, 2020 (2 pages).
Office Action issued in corresponding Argentina Patent Application No. P150101211, (5 pages).
English explanation of the Office Action issued in corresponding Argentina Patent Application No. P150101211, (2 pages).
Examination Report issued in corresponding Australian Patent Application No. 2015249739, dated Aug. 10, 2020 (5 pages).
Extended European Search Report received in corresponding European Patent Application No. 20171648.7, dated Oct. 23, 2020 (10 pages).
Third Office Action received in corresponding Chinese Patent Application No. 201580033738.0, dated Mar. 3, 2021 (3 pages).
English translation of the Third Office Action received in corresponding Chinese Patent Application No. 201580033738.0, dated Mar. 3, 2021 (1 page).
Office Action issued in corresponding Mexican Patent Application No. MX/a/2016/013877, dated Jan. 11, 2021 (5 pages).
English translation of the Office Action issued in corresponding Mexican Patent Application No. MX/a/2016/013877, dated Jan. 11, 2021 (6 pages).
Ahern, Holly, "Biochemical, Reagent Kits Offer Scientists Good Return on Investment," The Scientist, Jul. 24, 1995, vol. 9, No. 15, pp. 1-5.
Armitage et al., "Hairpin-Forming Peptide Nucleic Acid Oligomers," Biochemistry, 1998, vol. 37, pp. 9417-9425.
Craw et al., "Isothermal nucleic acid amplification technologies for point-of-care diagnostics: a critical review," Lab on a Chip, 2012, vol. 12, No. 14, pp. 2469-2486.
Dames et al., "Characterization of Aberrant Melting Peaks in Unlabeled Probe Assays," Journal of Molecular Diagnostics, Jul. 2007, vol. 9, No. 3, pp. 290-296.
Ehses et al., "Optimization and design of oligonucleotide setup for strand displacement amplification," Journal of Biochemical and Biophysical Methods, 2005, vol. 63, No. 3, pp. 170-186.
Holland et al., "Detection of specific polymerase chain reaction product by utilizing the 5'-3' exonuclease activity of Thermus aquaticus DNA polymerase," Proceedings of the National Academy of Sciences of the United States of America, Aug. 1991, vol. 88, pp. 7276-7280.
IDT, "The Polymerase Chain Reaction," Integrated DNA Technologies, 2011, pp. 1-21.
Ito, et al., "Synthesis, thermal stability and resistance to enzymatic hydrolysis of the oligonucleotides containing 5-(N-aminohexyl)carbamoyl-2'-O-methyluridines," Nucleic Acids Research, 2003, vol. 31, No. 10, pp. 2514-2523.
Li et al., "Enzymatic signal amplification of molecular beacons for sensitive DNA detection," Nucleic Acids Research, 2008, vol. 36, No. 6, e36, pp. 1-17.
Mann et al., "A thermodynamic approach to PCR primer design," Nucleic Acids Research, 2009, vol. 37, No. 13, e95, pp. 1-9.
Markham et al., "UNAFold: Software for Nucleic Acid Folding and Hybridization," Bioinformatics, vol. II: Structure, Function and Applications, Sep. 2, 2008, vol. 453, pp. 1-33.
Notomi et al., "Loop-mediated isothermal amplification of DNA," Nucleic Acids Research, 2000, vol. 28, No. 12, e63, pp. 1-7.
Paulasova et al., "The peptide nucleic acids (PNAs): a new generation of probes for genetic and cytogenetic analyses," Annales de Génétique, 2004, vol. 47, pp. 349-358.

(56) References Cited

OTHER PUBLICATIONS

"PCR Primer Design Guidelines," Premier Biosoft, www.premierbiosoft.com/tech_notes/PCR_Primer_Design.html.

Prediger, Ellen, "Designing PCR Primers and Probes," Decoded, Oct. 2013, vol. 3, No. 4, pp. 2-3.

"Primer Dimer," Wikipedia, the free encyclopedia, retrieved from the Internet Feb. 14, 2020 https://en.wikipedia.org/wiki/Primer_dimer.

Santalucia, Jr et al., "The Thermodynamics of DNA Structural Motifs," Annual Review of Biophysics and Biomolecular Structure, Jun. 9, 2004, vol. 33, pp. 415-440.

Santangelo et al., "Dual FRET molecular beacons for mRNA detection in living cells," Nucleic Acids Research, 2004, vol. 32, No. 6, e57, pp. 1-9.

Stofer et al., "Free Energy Calculations of Watson-Crick Base Pairing in Aqueous Solution," Journal of the American Chemical Society, 1999, vol. 121, No. 41, pp. 9503-9508.

Tyagi et al., "Molecular Beacons: Probes that Fluoresce upon Hybridization," Nature Biotechnology, Mar. 1996, vol. 14, pp. 303-308.

Untergasser et al., "Primer3—new capabilities and interfaces," Nucleic Acids Research, 2012, vol. 40, No. 15, e115, pp. 1-12.

Yan et al., "Isothermal amplified detection of DNA and RNA," Molecular BioSystems, 2014, vol. 10, No. 5, pp. 970-1003.

Office Action dated Apr. 14, 2021 in corresponding Canadian Patent Application No. 2,946,737 (5 pages).

Notice of Opposition dated Mar. 9, 2021 in corresponding European Patent Application No. 15783300.5 (47 pages).

Response submitted Sep. 29, 2021 in the opposition proceedings of corresponding European Patent Application No. 15783300.5 (128 pages).

Affidavit of Professor John SantaLucia submitted Sep. 29, 2021 in the opposition proceedings of corresponding European Patent Application No. 15783300.5 (44 pages).

Dirks et al., "Triggered amplification by hybridization chain reaction", Proceedings National Academy of Sciences PNAS, vol. 101, No. 43, Oct. 26, 2004, pp. 15275-15278.

Krishnan et al., "Nucleic Acid Based Molecular Devices", Angewandte Chemie International Edition, vol. 50, No. 14, Mar. 22, 2011, pp. 3124-3156.

Owczarzy et al., "IDT SciTools: a suite for analysis and design of nucleic acid oligomers", Nucleic Acids Research, vol. 36, Web Server Issue, pp. W163-W169.

Extended European Search Report for corresponding European Application No. 15783300.5, dated Nov. 8, 2017 (10 pages).

Office Action dated May 5, 2022 in corresponding Canadian Patent Application No. 2,946,737 (3 pages).

\* cited by examiner

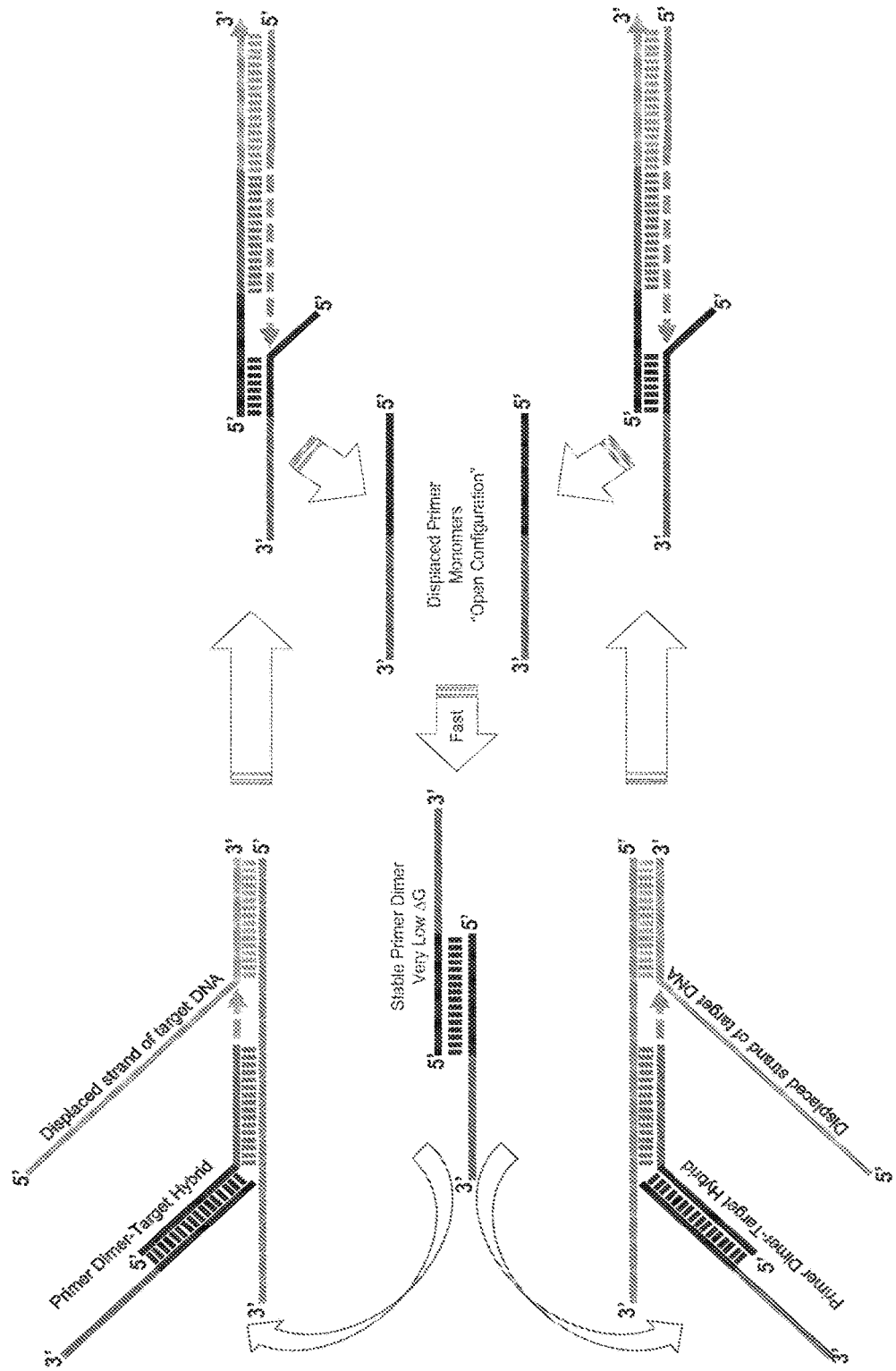

Fig. 1 Mechanism of an efficient isothermal reaction with exponential amplification, where at all times the active primer configuration is a dimer that is "recycled" to form new dimers from monomers released as result of polymerase strand displacement action. Ideally, at no point during the reaction the primers are present as an monomer with an open configuration, which could either serve as a template or primer for non-target-specific primer extension reactions amplifying background. The transition from monomer to dimer is "instantaneous" driven by thermodynamic factors (very low ΔG of dimer, high primer concentration, high dimer Tm) favoring the dimer formation.

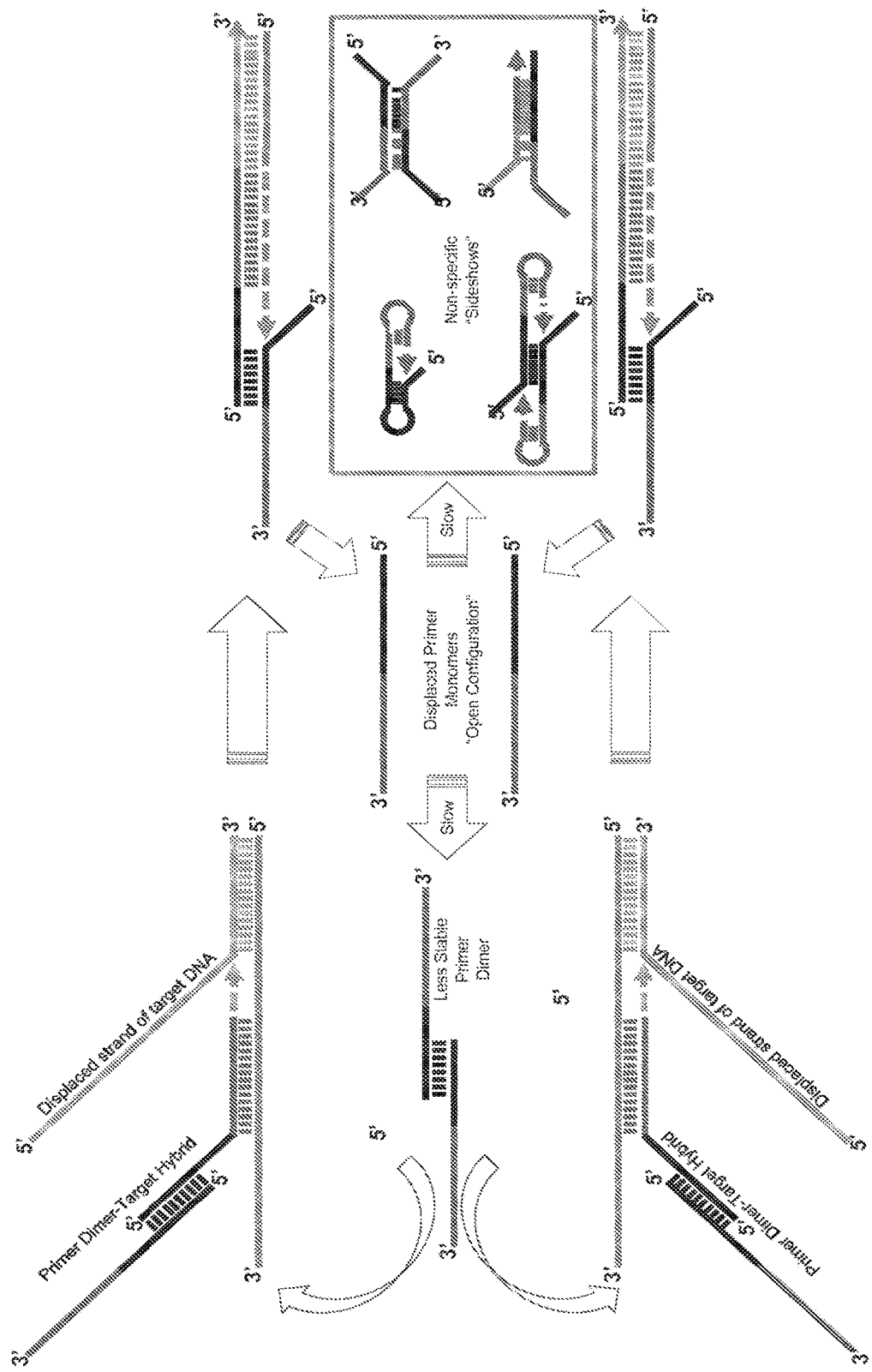

Fig 2. Mechanism of an inefficient isothermal reaction with background amplification, where monomer primers with an open configuration persists throughout the reaction leading to linear non-specific background amplification. A primer monomer with a fully or partially open configuration can serve either as a template or primer for non-target-specific primer extension reactions. The transition from monomer to dimer is slow, because it is not favored by thermodynamic factors (many different dimer and partial dimer configurations co-exist with similar ΔG's and low dimer Tm's).

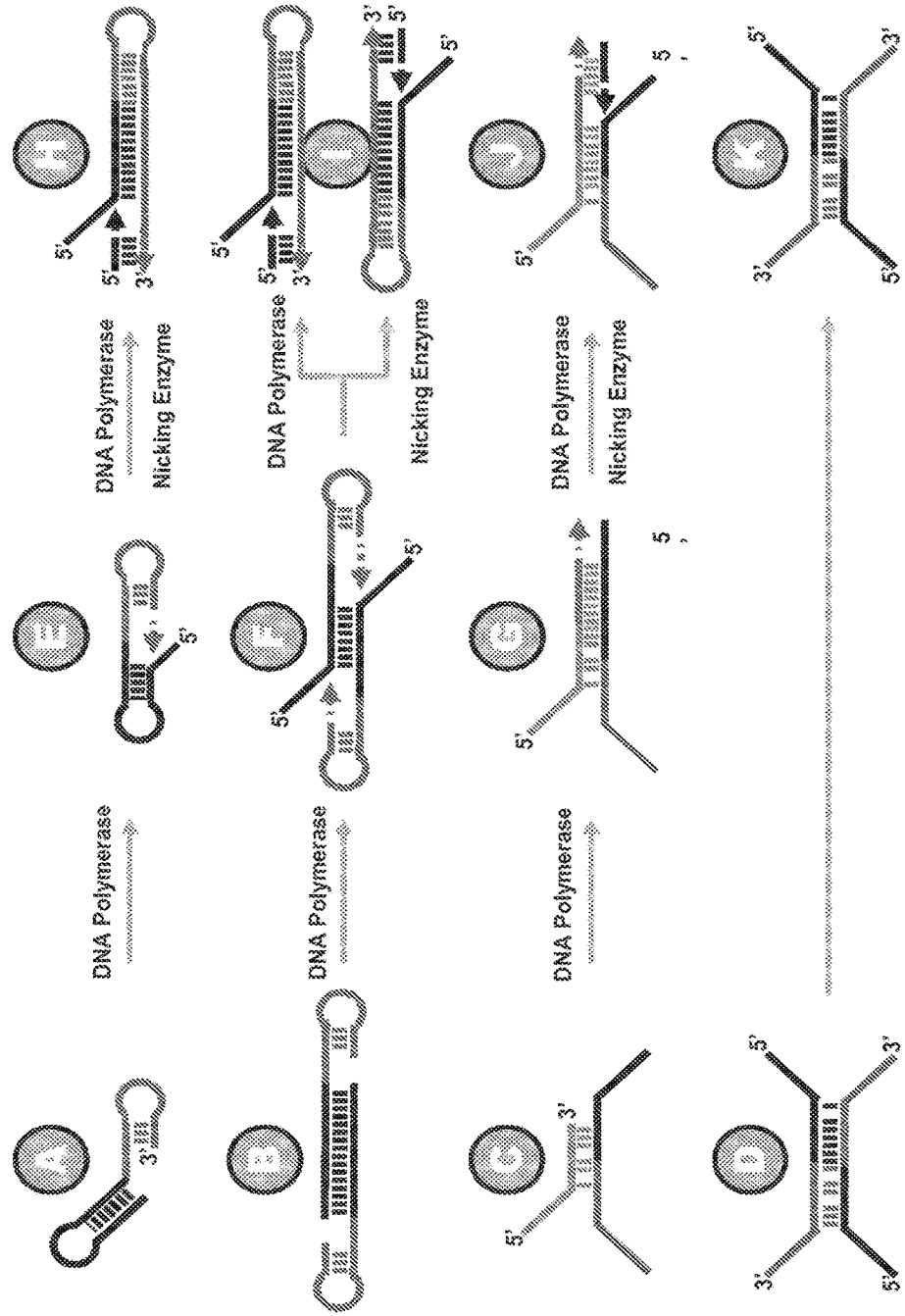

Fig 3. Primer structures leading to amplification of non-specific by-products (A to C) or incapable of target hybridization (D, K) : A) Primer monomer with discontinuous inverted sequence in target specific region "looping" back to create an extendable 3'-end for "self-replication". B) Like A) in primer dimer structure. C) False hybrid structures between primer monomer in "open" configuration and single stranded DNA fragments (gray) displaced by DNA polymerase nick-extension reactions from closely positioned random and/or sequence-specific nicks in template DNA . D) Partially double-stranded primer dimer structures, where a significant part of the target-specific region is not accessible for target hybridization, formed by inverted sequence repeats. E) to G) Intermediate, false primer extension/strand displacement reaction products. H) to J) Mature, false reaction products in 'nick & kick' mode, continuously recycling and amplifying single stranded by-products. K)

Sequences of 5'-tails
NNNNGACTCNNNNNNGAGTCNNNN (SEQ ID NO: 15272)
1100 Selected Sequences = 0.2% of entire sequence space (537824)
ΔG = -48 Kcal/mole to -62 kcal/mole       ΔΔG < -40 kcal/mole
GC content 68% to 84%

| SEQ ID NO: | | SEQ ID NO: | |
|---|---|---|---|
| 582 | GGCGGACTCGCGCGCGAGTCCGCC | 1974 | GGCGGACTCTCGCGAGAGTCCGCC |
| 591 | GCCCGACTCGCGCGCGAGTCGGGC | 1983 | GCCCGACTCTCGCGAGAGTCGGGC |
| 599 | GGGCGACTCGCGCGCGAGTCGCCC | 1991 | GGGCGACTCTCGCGAGAGTCGCCC |
| 603 | GGGAGACTCGCGCGCGAGTCTCCC | 1995 | GGGAGACTCTCGCGAGAGTCTCCC |
| 606 | GGGTGACTCGCGCGCGAGTCACCC | 1998 | GGGTGACTCTCGCGAGAGTCACCC |
| 602 | GGACGACTCGCGCGCGAGTCGTCC | 1994 | GGACGACTCTCGCGAGAGTCGTCC |
| 594 | GCACGACTCGCGCGCGAGTCGTGC | 1986 | GCACGACTCTCGCGAGAGTCGTGC |
| 593 | GACCGACTCGCGCGCGAGTCGGTC | 1985 | GACCGACTCTCGCGAGAGTCGGTC |
| 597 | GTCCGACTCGCGCGCGAGTCGGAC | 1989 | GTCCGACTCTCGCGAGAGTCGGAC |
| 592 | ACCCGACTCGCGCGCGAGTCGGGT | 1984 | ACCCGACTCTCGCGAGAGTCGGGT |
| 596 | TCCCGACTCGCGCGCGAGTCGGGA | 1988 | TCCCGACTCTCGCGAGAGTCGGGA |
| 595 | GCCAGACTCGCGCGCGAGTCTGGC | 1987 | GCCAGACTCTCGCGAGAGTCTGGC |
| 598 | GCCTGACTCGCGCGCGAGTCAGGC | 1990 | GCCTGACTCTCGCGAGAGTCAGGC |
| 584 | GACGGACTCGCGCGCGAGTCCGTC | 1976 | GACGGACTCTCGCGAGAGTCCGTC |
| 588 | GTCGGACTCGCGCGCGAGTCCGAC | 1980 | GTCGGACTCTCGCGAGAGTCCGAC |
| 583 | AGCGGACTCGCGCGCGAGTCCGCT | 1975 | AGCGGACTCTCGCGAGAGTCCGCT |
| 587 | TGCGGACTCGCGCGCGAGTCCGCA | 1979 | TGCGGACTCTCGCGAGAGTCCGCA |
| 585 | GGAGGACTCGCGCGCGAGTCCTCC | 1977 | GGAGGACTCTCGCGAGAGTCCTCC |
| 589 | GGTGGACTCGCGCGCGAGTCCACC | 1981 | GGTGGACTCTCGCGAGAGTCCACC |
| 586 | GGCAGACTCGCGCGCGAGTCTGCC | 1978 | GGCAGACTCTCGCGAGAGTCTGCC |
| 590 | GGCTGACTCGCGCGCGAGTCAGCC | 1982 | GGCTGACTCTCGCGAGAGTCAGCC |
| 621 | CACGGACTCGCGCGCGAGTCCGTG | 2013 | CACGGACTCTCGCGAGAGTCCGTG |
| 623 | CTCGGACTCGCGCGCGAGTCCGAG | 2015 | CTCGGACTCTCGCGAGAGTCCGAG |
| 609 | CCAGGACTCGCGCGCGAGTCCTGG | 2001 | CCAGGACTCTCGCGAGAGTCCTGG |
| 613 | CCTGGACTCGCGCGCGAGTCCAGG | 2005 | CCTGGACTCTCGCGAGAGTCCAGG |
| 622 | CCCAGACTCGCGCGCGAGTCTGGG | 2014 | CCCAGACTCTCGCGAGAGTCTGGG |
| 624 | CCCTGACTCGCGCGCGAGTCAGGG | 2016 | CCCTGACTCTCGCGAGAGTCAGGG |
| 607 | ACGGGACTCGCGCGCGAGTCCCGT | 1999 | ACGGGACTCTCGCGAGAGTCCCGT |
| 611 | TCGGGACTCGCGCGCGAGTCCCGA | 2003 | TCGGGACTCTCGCGAGAGTCCCGA |
| 608 | CAGGGACTCGCGCGCGAGTCCCTG | 2000 | CAGGGACTCTCGCGAGAGTCCCTG |
| 612 | CTGGGACTCGCGCGCGAGTCCCAG | 2004 | CTGGGACTCTCGCGAGAGTCCCAG |
| 15329 | CCGGACTCCGCGCGGAGTCCGG | 15399 | CCGGGACTCTGCGCAGAGTCCCGG |
| 15330 | CCCGGACTCCGCGCGGAGTCCGGG | 15400 | CCCGGACTCTGCGCAGAGTCCGGG |
| 176 | GGCGGACTCCGCGCGGAGTCCGCC | 408 | GGCGGACTCTGCGCAGAGTCCGCC |
| 15331 | GCCGGACTCCGCGCGGAGTCCGGC | 15401 | GCCGGACTCTGCGCAGAGTCCGGC |

FIG. 8A

| | | | |
|---|---|---|---|
| 185 | GCCCGACTCCGCGCGGAGTCGGGC | 417 | GCCCGACTCTGCGCAGAGTCGGGC |
| 15332 | GGCCGACTCCGCGCGGAGTCGGCC | 15402 | GGCCGACTCTGCGCAGAGTCGGCC |
| 193 | GGGCGACTCCGCGCGGAGTCGCCC | 425 | GGGCGACTCTGCGCAGAGTCGCCC |
| 197 | GGGAGACTCCGCGCGGAGTCTCCC | 429 | GGGAGACTCTGCGCAGAGTCTCCC |
| 200 | GGGTGACTCCGCGCGGAGTCACCC | 432 | GGGTGACTCTGCGCAGAGTCACCC |
| 196 | GGACGACTCCGCGCGGAGTCGTCC | 428 | GGACGACTCTGCGCAGAGTCGTCC |
| 15333 | GGTCGACTCCGCGCGGAGTCGACC | 15403 | GGTCGACTCTGCGCAGAGTCGACC |
| 188 | GCACGACTCCGCGCGGAGTCGTGC | 420 | GCACGACTCTGCGCAGAGTCGTGC |
| 15334 | GCTCGACTCCGCGCGGAGTCGAGC | 15404 | GCTCGACTCTGCGCAGAGTCGAGC |
| 187 | GACCGACTCCGCGCGGAGTCGGTC | 419 | GACCGACTCTGCGCAGAGTCGGTC |
| 191 | GTCCGACTCCGCGCGGAGTCGGAC | 423 | GTCCGACTCTGCGCAGAGTCGGAC |
| 186 | ACCCGACTCCGCGCGGAGTCGGGT | 418 | ACCCGACTCTGCGCAGAGTCGGGT |
| 190 | TCCCGACTCCGCGCGGAGTCGGGA | 422 | TCCCGACTCTGCGCAGAGTCGGGA |
| 189 | GCCAGACTCCGCGCGGAGTCTGGC | 421 | GCCAGACTCTGCGCAGAGTCTGGC |
| 192 | GCCTGACTCCGCGCGGAGTCAGGC | 424 | GCCTGACTCTGCGCAGAGTCAGGC |
| 178 | GACGGACTCCGCGCGGAGTCCGTC | 410 | GACGGACTCTGCGCAGAGTCCGTC |
| 182 | GTCGGACTCCGCGCGGAGTCCGAC | 414 | GTCGGACTCTGCGCAGAGTCCGAC |
| 15335 | ACCGGACTCCGCGCGGAGTCCGGT | 15405 | ACCGGACTCTGCGCAGAGTCCGGT |
| 15336 | TCCGGACTCCGCGCGGAGTCCGGA | 15406 | TCCGGACTCTGCGCAGAGTCCGGA |
| 177 | AGCGGACTCCGCGCGGAGTCCGCT | 409 | AGCGGACTCTGCGCAGAGTCCGCT |
| 181 | TGCGGACTCCGCGCGGAGTCCGCA | 413 | TGCGGACTCTGCGCAGAGTCCGCA |
| 179 | GGAGGACTCCGCGCGGAGTCCTCC | 411 | GGAGGACTCTGCGCAGAGTCCTCC |
| 183 | GGTGGACTCCGCGCGGAGTCCACC | 415 | GGTGGACTCTGCGCAGAGTCCACC |
| 180 | GGCAGACTCCGCGCGGAGTCTGCC | 412 | GGCAGACTCTGCGCAGAGTCTGCC |
| 184 | GGCTGACTCCGCGCGGAGTCAGCC | 416 | GGCTGACTCTGCGCAGAGTCAGCC |
| 215 | CACGGACTCCGCGCGGAGTCCGTG | 447 | CACGGACTCTGCGCAGAGTCCGTG |
| 217 | CTCGGACTCCGCGCGGAGTCCGAG | 449 | CTCGGACTCTGCGCAGAGTCCGAG |
| 203 | CCAGGACTCCGCGCGGAGTCCTGG | 435 | CCAGGACTCTGCGCAGAGTCCTGG |
| 207 | CCTGGACTCCGCGCGGAGTCCAGG | 439 | CCTGGACTCTGCGCAGAGTCCAGG |
| 216 | CCCAGACTCCGCGCGGAGTCTGGG | 448 | CCCAGACTCTGCGCAGAGTCTGGG |
| 218 | CCCTGACTCCGCGCGGAGTCAGGG | 450 | CCCTGACTCTGCGCAGAGTCAGGG |
| 201 | ACGGGACTCCGCGCGGAGTCCCGT | 433 | ACGGGACTCTGCGCAGAGTCCCGT |
| 205 | TCGGGACTCCGCGCGGAGTCCCGA | 437 | TCGGGACTCTGCGCAGAGTCCCGA |
| 202 | CAGGGACTCCGCGCGGAGTCCCTG | 434 | CAGGGACTCTGCGCAGAGTCCCTG |
| 206 | CTGGGACTCCGCGCGGAGTCCCAG | 438 | CTGGGACTCTGCGCAGAGTCCCAG |
| | | | |
| 15337 | GGCGGACTCGGGCCCGAGTCCGCC | 350 | GGCGGACTCTGGCCAGAGTCCGCC |
| 15338 | GCCCGACTCGGGCCCGAGTCGGGC | 359 | GCCCGACTCTGGCCAGAGTCGGGC |
| 15339 | GGGCGACTCGGGCCCGAGTCGCCC | 367 | GGGCGACTCTGGCCAGAGTCGCCC |
| 15340 | GGGAGACTCGGGCCCGAGTCTCCC | 371 | GGGAGACTCTGGCCAGAGTCTCCC |
| 15341 | GGGTGACTCGGGCCCGAGTCACCC | 374 | GGGTGACTCTGGCCAGAGTCACCC |
| 15342 | GGACGACTCGGGCCCGAGTCGTCC | 370 | GGACGACTCTGGCCAGAGTCGTCC |
| 15343 | GCACGACTCGGGCCCGAGTCGTGC | 362 | GCACGACTCTGGCCAGAGTCGTGC |
| 15344 | GACCGACTCGGGCCCGAGTCGGTC | 361 | GACCGACTCTGGCCAGAGTCGGTC |

FIG. 8A (CONTINUED)

| | | | |
|---|---|---|---|
| 15345 | GTCCGACTCGGGCCCGAGTCGGAC | 365 | GTCCGACTCTGGCCAGAGTCGGAC |
| 15346 | ACCCGACTCGGGCCCGAGTCGGGT | 360 | ACCCGACTCTGGCCAGAGTCGGGT |
| 15347 | TCCCGACTCGGGCCCGAGTCGGGA | 364 | TCCCGACTCTGGCCAGAGTCGGGA |
| 15348 | GCCAGACTCGGGCCCGAGTCTGGC | 363 | GCCAGACTCTGGCCAGAGTCTGGC |
| 15349 | GCCTGACTCGGGCCCGAGTCAGGC | 366 | GCCTGACTCTGGCCAGAGTCAGGC |
| 15350 | GACGGACTCGGGCCCGAGTCCGTC | 352 | GACGGACTCTGGCCAGAGTCCGTC |
| 15351 | GTCGGACTCGGGCCCGAGTCCGAC | 356 | GTCGGACTCTGGCCAGAGTCCGAC |
| 15352 | AGCGGACTCGGGCCCGAGTCCGCT | 351 | AGCGGACTCTGGCCAGAGTCCGCT |
| 15353 | TGCGGACTCGGGCCCGAGTCCGCA | 355 | TGCGGACTCTGGCCAGAGTCCGCA |
| 15354 | GGAGGACTCGGGCCCGAGTCCTCC | 353 | GGAGGACTCTGGCCAGAGTCCTCC |
| 15355 | GGTGGACTCGGGCCCGAGTCCACC | 357 | GGTGGACTCTGGCCAGAGTCCACC |
| 15356 | GGCAGACTCGGGCCCGAGTCTGCC | 354 | GGCAGACTCTGGCCAGAGTCTGCC |
| 15357 | GGCTGACTCGGGCCCGAGTCAGCC | 358 | GGCTGACTCTGGCCAGAGTCAGCC |
| 15358 | CACGGACTCGGGCCCGAGTCCGTG | 389 | CACGGACTCTGGCCAGAGTCCGTG |
| 15359 | CTCGGACTCGGGCCCGAGTCCGAG | 391 | CTCGGACTCTGGCCAGAGTCCGAG |
| 15360 | CCAGGACTCGGGCCCGAGTCCTGG | 377 | CCAGGACTCTGGCCAGAGTCCTGG |
| 15361 | CCTGGACTCGGGCCCGAGTCCAGG | 381 | CCTGGACTCTGGCCAGAGTCCAGG |
| 15362 | CCCAGACTCGGGCCCGAGTCTGGG | 390 | CCCAGACTCTGGCCAGAGTCTGGG |
| 15363 | CCCTGACTCGGGCCCGAGTCAGGG | 392 | CCCTGACTCTGGCCAGAGTCAGGG |
| 15364 | ACGGGACTCGGGCCCGAGTCCCGT | 375 | ACGGGACTCTGGCCAGAGTCCCGT |
| 15365 | TCGGGACTCGGGCCCGAGTCCCGA | 379 | TCGGGACTCTGGCCAGAGTCCCGA |
| 15366 | CAGGGACTCGGGCCCGAGTCCCTG | 376 | CAGGGACTCTGGCCAGAGTCCCTG |
| 15367 | CTGGGACTCGGGCCCGAGTCCCAG | 380 | CTGGGACTCTGGCCAGAGTCCCAG |
| | | | |
| 1046 | GGCGGACTCCCGCGGGAGTCCGCC | 1974 | GGCGGACTCTCGCGAGAGTCCGCC |
| 1055 | GCCCGACTCCCGCGGGAGTCGGGC | 1983 | GCCCGACTCTCGCGAGAGTCGGGC |
| 1063 | GGGCGACTCCCGCGGGAGTCGCCC | 1991 | GGGCGACTCTCGCGAGAGTCGCCC |
| 1067 | GGGAGACTCCCGCGGGAGTCTCCC | 1995 | GGGAGACTCTCGCGAGAGTCTCCC |
| 1070 | GGGTGACTCCCGCGGGAGTCACCC | 1998 | GGGTGACTCTCGCGAGAGTCACCC |
| 1066 | GGACGACTCCCGCGGGAGTCGTCC | 1994 | GGACGACTCTCGCGAGAGTCGTCC |
| 1058 | GCACGACTCCCGCGGGAGTCGTGC | 1986 | GCACGACTCTCGCGAGAGTCGTGC |
| 1057 | GACCGACTCCCGCGGGAGTCGGTC | 1985 | GACCGACTCTCGCGAGAGTCGGTC |
| 1061 | GTCCGACTCCCGCGGGAGTCGGAC | 1989 | GTCCGACTCTCGCGAGAGTCGGAC |
| 1056 | ACCCGACTCCCGCGGGAGTCGGGT | 1984 | ACCCGACTCTCGCGAGAGTCGGGT |
| 1060 | TCCCGACTCCCGCGGGAGTCGGGA | 1988 | TCCCGACTCTCGCGAGAGTCGGGA |
| 1059 | GCCAGACTCCCGCGGGAGTCTGGC | 1987 | GCCAGACTCTCGCGAGAGTCTGGC |
| 1062 | GCCTGACTCCCGCGGGAGTCAGGC | 1990 | GCCTGACTCTCGCGAGAGTCAGGC |
| 1048 | GACGGACTCCCGCGGGAGTCCGTC | 1976 | GACGGACTCTCGCGAGAGTCCGTC |
| 1052 | GTCGGACTCCCGCGGGAGTCCGAC | 1980 | GTCGGACTCTCGCGAGAGTCCGAC |
| 1047 | AGCGGACTCCCGCGGGAGTCCGCT | 1975 | AGCGGACTCTCGCGAGAGTCCGCT |
| 1051 | TGCGGACTCCCGCGGGAGTCCGCA | 1979 | TGCGGACTCTCGCGAGAGTCCGCA |
| 1049 | GGAGGACTCCCGCGGGAGTCCTCC | 1977 | GGAGGACTCTCGCGAGAGTCCTCC |
| 1053 | GGTGGACTCCCGCGGGAGTCCACC | 1981 | GGTGGACTCTCGCGAGAGTCCACC |
| 1050 | GGCAGACTCCCGCGGGAGTCTGCC | 1978 | GGCAGACTCTCGCGAGAGTCTGCC |

FIG. 8A (CONTINUED)

| | | | |
|---|---|---|---|
| 1054 | GGCTGACTCCCGCGGGAGTCAGCC | 1982 | GGCTGACTCTCGCGAGAGTCAGCC |
| 1085 | CACGGACTCCCGCGGGAGTCCGTG | 2013 | CACGGACTCTCGCGAGAGTCCGTG |
| 1087 | CTCGGACTCCCGCGGGAGTCCGAG | 2015 | CTCGGACTCTCGCGAGAGTCCGAG |
| 1073 | CCAGGACTCCCGCGGGAGTCCTGG | 2001 | CCAGGACTCTCGCGAGAGTCCTGG |
| 1077 | CCTGGACTCCCGCGGGAGTCCAGG | 2005 | CCTGGACTCTCGCGAGAGTCCAGG |
| 1086 | CCCAGACTCCCGCGGGAGTCTGGG | 2014 | CCCAGACTCTCGCGAGAGTCTGGG |
| 1088 | CCCTGACTCCCGCGGGAGTCAGGG | 2016 | CCCTGACTCTCGCGAGAGTCAGGG |
| 1071 | ACGGGACTCCCGCGGGAGTCCCGT | 1999 | ACGGGACTCTCGCGAGAGTCCCGT |
| 1075 | TCGGGACTCCCGCGGGAGTCCCGA | 2003 | TCGGGACTCTCGCGAGAGTCCCGA |
| 1072 | CAGGGACTCCCGCGGGAGTCCCTG | 2000 | CAGGGACTCTCGCGAGAGTCCCTG |
| 1076 | CTGGGACTCCCGCGGGAGTCCCAG | 2004 | CTGGGACTCTCGCGAGAGTCCCAG |
| | | | |
| 15368 | GGCGGACTCGGCGCCGAGTCCGCC | 408 | GGCGGACTCTGCGCAGAGTCCGCC |
| 15369 | GCCCGACTCGGCGCCGAGTCGGGC | 417 | GCCCGACTCTGCGCAGAGTCGGGC |
| 15370 | GGGCGACTCGGCGCCGAGTCGCCC | 425 | GGGCGACTCTGCGCAGAGTCGCCC |
| 15371 | GGGAGACTCGGCGCCGAGTCTCCC | 429 | GGGAGACTCTGCGCAGAGTCTCCC |
| 15372 | GGGTGACTCGGCGCCGAGTCACCC | 432 | GGGTGACTCTGCGCAGAGTCACCC |
| 15373 | GGACGACTCGGCGCCGAGTCGTCC | 428 | GGACGACTCTGCGCAGAGTCGTCC |
| 15374 | GCACGACTCGGCGCCGAGTCGTGC | 420 | GCACGACTCTGCGCAGAGTCGTGC |
| 15375 | GACCGACTCGGCGCCGAGTCGGTC | 419 | GACCGACTCTGCGCAGAGTCGGTC |
| 15376 | GTCCGACTCGGCGCCGAGTCGGAC | 423 | GTCCGACTCTGCGCAGAGTCGGAC |
| 15377 | ACCCGACTCGGCGCCGAGTCGGGT | 418 | ACCCGACTCTGCGCAGAGTCGGGT |
| 15378 | TCCCGACTCGGCGCCGAGTCGGGA | 422 | TCCCGACTCTGCGCAGAGTCGGGA |
| 15379 | GCCAGACTCGGCGCCGAGTCTGGC | 421 | GCCAGACTCTGCGCAGAGTCTGGC |
| 15380 | GCCTGACTCGGCGCCGAGTCAGGC | 424 | GCCTGACTCTGCGCAGAGTCAGGC |
| 15381 | GACGGACTCGGCGCCGAGTCCGTC | 410 | GACGGACTCTGCGCAGAGTCCGTC |
| 15382 | GTCGGACTCGGCGCCGAGTCCGAC | 414 | GTCGGACTCTGCGCAGAGTCCGAC |
| 15383 | AGCGGACTCGGCGCCGAGTCCGCT | 409 | AGCGGACTCTGCGCAGAGTCCGCT |
| 15384 | TGCGGACTCGGCGCCGAGTCCGCA | 413 | TGCGGACTCTGCGCAGAGTCCGCA |
| 15385 | GGAGGACTCGGCGCCGAGTCCTCC | 411 | GGAGGACTCTGCGCAGAGTCCTCC |
| 15386 | GGTGGACTCGGCGCCGAGTCCACC | 415 | GGTGGACTCTGCGCAGAGTCCACC |
| 15387 | GGCAGACTCGGCGCCGAGTCTGCC | 412 | GGCAGACTCTGCGCAGAGTCTGCC |
| 15388 | GGCTGACTCGGCGCCGAGTCAGCC | 416 | GGCTGACTCTGCGCAGAGTCAGCC |
| 15389 | CACGGACTCGGCGCCGAGTCCGTG | 447 | CACGGACTCTGCGCAGAGTCCGTG |
| 15390 | CTCGGACTCGGCGCCGAGTCCGAG | 449 | CTCGGACTCTGCGCAGAGTCCGAG |
| 15391 | CCAGGACTCGGCGCCGAGTCCTGG | 435 | CCAGGACTCTGCGCAGAGTCCTGG |
| 15392 | CCTGGACTCGGCGCCGAGTCCAGG | 439 | CCTGGACTCTGCGCAGAGTCCAGG |
| 15393 | CCCAGACTCGGCGCCGAGTCTGGG | 448 | CCCAGACTCTGCGCAGAGTCTGGG |
| 15394 | CCCTGACTCGGCGCCGAGTCAGGG | 450 | CCCTGACTCTGCGCAGAGTCAGGG |
| 15395 | ACGGGACTCGGCGCCGAGTCCCGT | 433 | ACGGGACTCTGCGCAGAGTCCCGT |
| 15396 | TCGGGACTCGGCGCCGAGTCCCGA | 437 | TCGGGACTCTGCGCAGAGTCCCGA |
| 15397 | CAGGGACTCGGCGCCGAGTCCCTG | 434 | CAGGGACTCTGCGCAGAGTCCCTG |
| 15398 | CTGGGACTCGGCGCCGAGTCCCAG | 438 | CTGGGACTCTGCGCAGAGTCCCAG |

FIG. 8A (CONTINUED)

| | | | |
|---|---|---|---|
| 640 | GGCGGACTCGCCGGCGAGTCCGCC | 2032 | GGCGGACTCTCCGGAGAGTCCGCC |
| 649 | GCCCGACTCGCCGGCGAGTCGGGC | 2041 | GCCCGACTCTCCGGAGAGTCGGGC |
| 657 | GGGCGACTCGCCGGCGAGTCGCCC | 2049 | GGGCGACTCTCCGGAGAGTCGCCC |
| 661 | GGGAGACTCGCCGGCGAGTCTCCC | 2053 | GGGAGACTCTCCGGAGAGTCTCCC |
| 664 | GGGTGACTCGCCGGCGAGTCACCC | 2056 | GGGTGACTCTCCGGAGAGTCACCC |
| 660 | GGACGACTCGCCGGCGAGTCGTCC | 2052 | GGACGACTCTCCGGAGAGTCGTCC |
| 652 | GCACGACTCGCCGGCGAGTCGTGC | 2044 | GCACGACTCTCCGGAGAGTCGTGC |
| 651 | GACCGACTCGCCGGCGAGTCGGTC | 2043 | GACCGACTCTCCGGAGAGTCGGTC |
| 655 | GTCCGACTCGCCGGCGAGTCGGAC | 2047 | GTCCGACTCTCCGGAGAGTCGGAC |
| 650 | ACCCGACTCGCCGGCGAGTCGGGT | 2042 | ACCCGACTCTCCGGAGAGTCGGGT |
| 654 | TCCCGACTCGCCGGCGAGTCGGGA | 2046 | TCCCGACTCTCCGGAGAGTCGGGA |
| 653 | GCCAGACTCGCCGGCGAGTCTGGC | 2045 | GCCAGACTCTCCGGAGAGTCTGGC |
| 656 | GCCTGACTCGCCGGCGAGTCAGGC | 2048 | GCCTGACTCTCCGGAGAGTCAGGC |
| 642 | GACGGACTCGCCGGCGAGTCCGTC | 2034 | GACGGACTCTCCGGAGAGTCCGTC |
| 646 | GTCGGACTCGCCGGCGAGTCCGAC | 2038 | GTCGGACTCTCCGGAGAGTCCGAC |
| 641 | AGCGGACTCGCCGGCGAGTCCGCT | 2033 | AGCGGACTCTCCGGAGAGTCCGCT |
| 645 | TGCGGACTCGCCGGCGAGTCCGCA | 2037 | TGCGGACTCTCCGGAGAGTCCGCA |
| 643 | GGAGGACTCGCCGGCGAGTCCTCC | 2035 | GGAGGACTCTCCGGAGAGTCCTCC |
| 647 | GGTGGACTCGCCGGCGAGTCCACC | 2039 | GGTGGACTCTCCGGAGAGTCCACC |
| 644 | GGCAGACTCGCCGGCGAGTCTGCC | 2036 | GGCAGACTCTCCGGAGAGTCTGCC |
| 648 | GGCTGACTCGCCGGCGAGTCAGCC | 2040 | GGCTGACTCTCCGGAGAGTCAGCC |
| 679 | CACGGACTCGCCGGCGAGTCCGTG | 2071 | CACGGACTCTCCGGAGAGTCCGTG |
| 681 | CTCGGACTCGCCGGCGAGTCCGAG | 2073 | CTCGGACTCTCCGGAGAGTCCGAG |
| 667 | CCAGGACTCGCCGGCGAGTCCTGG | 2059 | CCAGGACTCTCCGGAGAGTCCTGG |
| 671 | CCTGGACTCGCCGGCGAGTCCAGG | 2063 | CCTGGACTCTCCGGAGAGTCCAGG |
| 680 | CCCAGACTCGCCGGCGAGTCTGGG | 2072 | CCCAGACTCTCCGGAGAGTCTGGG |
| 682 | CCCTGACTCGCCGGCGAGTCAGGG | 2074 | CCCTGACTCTCCGGAGAGTCAGGG |
| 665 | ACGGGACTCGCCGGCGAGTCCCGT | 2057 | ACGGGACTCTCCGGAGAGTCCCGT |
| 669 | TCGGGACTCGCCGGCGAGTCCCGA | 2061 | TCGGGACTCTCCGGAGAGTCCCGA |
| 666 | CAGGGACTCGCCGGCGAGTCCCTG | 2058 | CAGGGACTCTCCGGAGAGTCCCTG |
| 670 | CTGGGACTCGCCGGCGAGTCCCAG | 2062 | CTGGGACTCTCCGGAGAGTCCCAG |

FIG. 8A (CONTINUED)

| SEQ ID NO: | | SEQ ID NO: | |
|---|---|---|---|
| 814 | GGCGGACTCACGCGTGAGTCCGCC | 1278 | GGCGGACTCGTGCACGAGTCCGCC |
| 823 | GCCCGACTCACGCGTGAGTCGGGC | 1287 | GCCCGACTCGTGCACGAGTCGGGC |
| 831 | GGGCGACTCACGCGTGAGTCGCCC | 1295 | GGGCGACTCGTGCACGAGTCGCCC |
| 835 | GGGAGACTCACGCGTGAGTCTCCC | 1299 | GGGAGACTCGTGCACGAGTCTCCC |
| 838 | GGGTGACTCACGCGTGAGTCACCC | 1302 | GGGTGACTCGTGCACGAGTCACCC |
| 834 | GGACGACTCACGCGTGAGTCGTCC | 1298 | GGACGACTCGTGCACGAGTCGTCC |
| 826 | GCACGACTCACGCGTGAGTCGTGC | 1290 | GCACGACTCGTGCACGAGTCGTGC |
| 825 | GACCGACTCACGCGTGAGTCGGTC | 1289 | GACCGACTCGTGCACGAGTCGGTC |
| 829 | GTCCGACTCACGCGTGAGTCGGAC | 1293 | GTCCGACTCGTGCACGAGTCGGAC |
| 824 | ACCCGACTCACGCGTGAGTCGGGT | 1288 | ACCCGACTCGTGCACGAGTCGGGT |
| 828 | TCCCGACTCACGCGTGAGTCGGGA | 1292 | TCCCGACTCGTGCACGAGTCGGGA |
| 827 | GCCAGACTCACGCGTGAGTCTGGC | 1291 | GCCAGACTCGTGCACGAGTCTGGC |
| 830 | GCCTGACTCACGCGTGAGTCAGGC | 1294 | GCCTGACTCGTGCACGAGTCAGGC |
| 816 | GACGGACTCACGCGTGAGTCCGTC | 1280 | GACGGACTCGTGCACGAGTCCGTC |
| 820 | GTCGGACTCACGCGTGAGTCCGAC | 1284 | GTCGGACTCGTGCACGAGTCCGAC |
| 815 | AGCGGACTCACGCGTGAGTCCGCT | 1279 | AGCGGACTCGTGCACGAGTCCGCT |
| 819 | TGCGGACTCACGCGTGAGTCCGCA | 1283 | TGCGGACTCGTGCACGAGTCCGCA |
| 817 | GGAGGACTCACGCGTGAGTCCTCC | 1281 | GGAGGACTCGTGCACGAGTCCTCC |
| 821 | GGTGGACTCACGCGTGAGTCCACC | 1285 | GGTGGACTCGTGCACGAGTCCACC |
| 818 | GGCAGACTCACGCGTGAGTCTGCC | 1282 | GGCAGACTCGTGCACGAGTCTGCC |
| 822 | GGCTGACTCACGCGTGAGTCAGCC | 1286 | GGCTGACTCGTGCACGAGTCAGCC |
| 853 | CACGGACTCACGCGTGAGTCCGTG | 1317 | CACGGACTCGTGCACGAGTCCGTG |
| 855 | CTCGGACTCACGCGTGAGTCCGAG | 1319 | CTCGGACTCGTGCACGAGTCCGAG |
| 841 | CCAGGACTCACGCGTGAGTCCTGG | 1305 | CCAGGACTCGTGCACGAGTCCTGG |
| 845 | CCTGGACTCACGCGTGAGTCCAGG | 1309 | CCTGGACTCGTGCACGAGTCCAGG |
| 854 | CCCAGACTCACGCGTGAGTCTGGG | 1318 | CCCAGACTCGTGCACGAGTCTGGG |
| 856 | CCCTGACTCACGCGTGAGTCAGGG | 1320 | CCCTGACTCGTGCACGAGTCAGGG |
| 839 | ACGGGACTCACGCGTGAGTCCCGT | 1303 | ACGGGACTCGTGCACGAGTCCCGT |
| 843 | TCGGGACTCACGCGTGAGTCCCGA | 1307 | TCGGGACTCGTGCACGAGTCCCGA |
| 840 | CAGGGACTCACGCGTGAGTCCCTG | 1304 | CAGGGACTCGTGCACGAGTCCCTG |
| 844 | CTGGGACTCACGCGTGAGTCCCAG | 1308 | CTGGGACTCGTGCACGAGTCCCAG |
| 15407 | CCGGGACTCAGCGCTGAGTCCCGG | 15416 | CCGGGACTCCTCGAGGAGTCCCGG |
| 15408 | CCCGGACTCAGCGCTGAGTCCGGG | 15417 | CCCGGACTCCTCGAGGAGTCCGGG |
| 2264 | GGCGGACTCAGCGCTGAGTCCGCC | 1568 | GGCGGACTCCTCGAGGAGTCCGCC |
| 15409 | GCCGGACTCAGCGCTGAGTCCGGC | 15418 | GCCGGACTCCTCGAGGAGTCCGGC |

FIG. 8A (CONTINUED)

| | | | |
|---|---|---|---|
| 2273 | GCCCGACTCAGCGCTGAGTCGGGC | 1577 | GCCCGACTCCTCGAGGAGTCGGGC |
| 15410 | GGCCGACTCAGCGCTGAGTCGGCC | 15419 | GGCCGACTCCTCGAGGAGTCGGCC |
| 2281 | GGGCGACTCAGCGCTGAGTCGCCC | 1585 | GGGCGACTCCTCGAGGAGTCGCCC |
| 2285 | GGGAGACTCAGCGCTGAGTCTCCC | 1589 | GGGAGACTCCTCGAGGAGTCTCCC |
| 2288 | GGGTGACTCAGCGCTGAGTCACCC | 1592 | GGGTGACTCCTCGAGGAGTCACCC |
| 2284 | GGACGACTCAGCGCTGAGTCGTCC | 1588 | GGACGACTCCTCGAGGAGTCGTCC |
| 15411 | GGTCGACTCAGCGCTGAGTCGACC | 15420 | GGTCGACTCCTCGAGGAGTCGACC |
| 2276 | GCACGACTCAGCGCTGAGTCGTGC | 1580 | GCACGACTCCTCGAGGAGTCGTGC |
| 15412 | GCTCGACTCAGCGCTGAGTCGAGC | 15421 | GCTCGACTCCTCGAGGAGTCGAGC |
| 2275 | GACCGACTCAGCGCTGAGTCGGTC | 1579 | GACCGACTCCTCGAGGAGTCGGTC |
| 2279 | GTCCGACTCAGCGCTGAGTCGGAC | 1583 | GTCCGACTCCTCGAGGAGTCGGAC |
| 2274 | ACCCGACTCAGCGCTGAGTCGGGT | 1578 | ACCCGACTCCTCGAGGAGTCGGGT |
| 2278 | TCCCGACTCAGCGCTGAGTCGGGA | 1582 | TCCCGACTCCTCGAGGAGTCGGGA |
| 2277 | GCCAGACTCAGCGCTGAGTCTGGC | 1581 | GCCAGACTCCTCGAGGAGTCTGGC |
| 2280 | GCCTGACTCAGCGCTGAGTCAGGC | 1584 | GCCTGACTCCTCGAGGAGTCAGGC |
| 2266 | GACGGACTCAGCGCTGAGTCCGTC | 1570 | GACGGACTCCTCGAGGAGTCCGTC |
| 2270 | GTCGGACTCAGCGCTGAGTCCGAC | 1574 | GTCGGACTCCTCGAGGAGTCCGAC |
| 15413 | ACCGGACTCAGCGCTGAGTCCGGT | 15422 | ACCGGACTCCTCGAGGAGTCCGGT |
| 15414 | TCCGGACTCAGCGCTGAGTCCGGA | 15423 | TCCGGACTCCTCGAGGAGTCCGGA |
| 2265 | AGCGGACTCAGCGCTGAGTCCGCT | 1569 | AGCGGACTCCTCGAGGAGTCCGCT |
| 2269 | TGCGGACTCAGCGCTGAGTCCGCA | 1573 | TGCGGACTCCTCGAGGAGTCCGCA |
| 2267 | GGAGGACTCAGCGCTGAGTCCTCC | 1571 | GGAGGACTCCTCGAGGAGTCCTCC |
| 2271 | GGTGGACTCAGCGCTGAGTCCACC | 1575 | GGTGGACTCCTCGAGGAGTCCACC |
| 2268 | GGCAGACTCAGCGCTGAGTCTGCC | 1572 | GGCAGACTCCTCGAGGAGTCTGCC |
| 2272 | GGCTGACTCAGCGCTGAGTCAGCC | 1576 | GGCTGACTCCTCGAGGAGTCAGCC |
| 2303 | CACGGACTCAGCGCTGAGTCCGTG | 1607 | CACGGACTCCTCGAGGAGTCCGTG |
| 2305 | CTCGGACTCAGCGCTGAGTCCGAG | 1609 | CTCGGACTCCTCGAGGAGTCCGAG |
| 2291 | CCAGGACTCAGCGCTGAGTCCTGG | 1595 | CCAGGACTCCTCGAGGAGTCCTGG |
| 2295 | CCTGGACTCAGCGCTGAGTCCAGG | 1599 | CCTGGACTCCTCGAGGAGTCCAGG |
| 2304 | CCCAGACTCAGCGCTGAGTCTGGG | 1608 | CCCAGACTCCTCGAGGAGTCTGGG |
| 2306 | CCCTGACTCAGCGCTGAGTCAGGG | 1610 | CCCTGACTCCTCGAGGAGTCAGGG |
| 2289 | ACGGGACTCAGCGCTGAGTCCCGT | 1593 | ACGGGACTCCTCGAGGAGTCCCGT |
| 2293 | TCGGGACTCAGCGCTGAGTCCCGA | 1597 | TCGGGACTCCTCGAGGAGTCCCGA |
| 2290 | CAGGGACTCAGCGCTGAGTCCCTG | 1594 | CAGGGACTCCTCGAGGAGTCCCTG |
| 2294 | CTGGGACTCAGCGCTGAGTCCCAG | 1598 | CTGGGACTCCTCGAGGAGTCCCAG |
| | | | |
| 2206 | GGCGGACTCAGGCCTGAGTCCGCC | 15424 | GCCCGACTCGGTACCGAGTCGGGC |
| 2215 | GCCCGACTCAGGCCTGAGTCGGGC | 15424 | GCCCGACTCGGTACCGAGTCGGGC |
| 2223 | GGGCGACTCAGGCCTGAGTCGCCC | 15425 | GGGCGACTCGGTACCGAGTCGCCC |
| 2227 | GGGAGACTCAGGCCTGAGTCTCCC | 15426 | GGGAGACTCGGTACCGAGTCTCCC |
| 2230 | GGGTGACTCAGGCCTGAGTCACCC | 15427 | GGGTGACTCGGTACCGAGTCACCC |
| 2226 | GGACGACTCAGGCCTGAGTCGTCC | 15428 | GGACGACTCGGTACCGAGTCGTCC |
| 2218 | GCACGACTCAGGCCTGAGTCGTGC | 15429 | GCACGACTCGGTACCGAGTCGTGC |
| 2217 | GACCGACTCAGGCCTGAGTCGGTC | 15430 | GACCGACTCGGTACCGAGTCGGTC |

FIG. 8A (CONTINUED)

| | | | |
|---|---|---|---|
| 2221 | GTCCGACTCAGGCCTGAGTCGGAC | 15431 | GTCCGACTCGGTACCGAGTCGGAC |
| 2216 | ACCCGACTCAGGCCTGAGTCGGGT | 15432 | ACCCGACTCGGTACCGAGTCGGGT |
| 2220 | TCCCGACTCAGGCCTGAGTCGGGA | 15433 | TCCCGACTCGGTACCGAGTCGGGA |
| 2219 | GCCAGACTCAGGCCTGAGTCTGGC | 15434 | GCCAGACTCGGTACCGAGTCTGGC |
| 2222 | GCCTGACTCAGGCCTGAGTCAGGC | 15435 | GCCTGACTCGGTACCGAGTCAGGC |
| 2208 | GACGGACTCAGGCCTGAGTCCGTC | 15436 | GACGGACTCGGTACCGAGTCCGTC |
| 2212 | GTCGGACTCAGGCCTGAGTCCGAC | 15437 | GTCGGACTCGGTACCGAGTCCGAC |
| 2207 | AGCGGACTCAGGCCTGAGTCCGCT | 15438 | AGCGGACTCGGTACCGAGTCCGCT |
| 2211 | TGCGGACTCAGGCCTGAGTCCGCA | 15439 | TGCGGACTCGGTACCGAGTCCGCA |
| 2209 | GGAGGACTCAGGCCTGAGTCCTCC | 15440 | GGAGGACTCGGTACCGAGTCCTCC |
| 2213 | GGTGGACTCAGGCCTGAGTCCACC | 15441 | GGTGGACTCGGTACCGAGTCCACC |
| 2210 | GGCAGACTCAGGCCTGAGTCTGCC | 15442 | GGCAGACTCGGTACCGAGTCTGCC |
| 2214 | GGCTGACTCAGGCCTGAGTCAGCC | 15443 | GGCTGACTCGGTACCGAGTCAGCC |
| 2245 | CACGGACTCAGGCCTGAGTCCGTG | 15444 | CACGGACTCGGTACCGAGTCCGTG |
| 2247 | CTCGGACTCAGGCCTGAGTCCGAG | 15445 | CTCGGACTCGGTACCGAGTCCGAG |
| 2233 | CCAGGACTCAGGCCTGAGTCCTGG | 15446 | CCAGGACTCGGTACCGAGTCCTGG |
| 2237 | CCTGGACTCAGGCCTGAGTCCAGG | 15447 | CCTGGACTCGGTACCGAGTCCAGG |
| 2246 | CCCAGACTCAGGCCTGAGTCTGGG | 15448 | CCCAGACTCGGTACCGAGTCTGGG |
| 2248 | CCCTGACTCAGGCCTGAGTCAGGG | 15449 | CCCTGACTCGGTACCGAGTCAGGG |
| 2231 | ACGGGACTCAGGCCTGAGTCCCGT | 15450 | ACGGGACTCGGTACCGAGTCCCGT |
| 2235 | TCGGGACTCAGGCCTGAGTCCCGA | 15451 | TCGGGACTCGGTACCGAGTCCCGA |
| 2232 | CAGGGACTCAGGCCTGAGTCCCTG | 15452 | CAGGGACTCGGTACCGAGTCCCTG |
| 2236 | CTGGGACTCAGGCCTGAGTCCCAG | 15453 | CTGGGACTCGGTACCGAGTCCCAG |
| | | | |
| 814 | GGCGGACTCACGCGTGAGTCCGCC | 1510 | GGCGGACTCCTGCAGGAGTCCGCC |
| 823 | GCCCGACTCACGCGTGAGTCGGGC | 1519 | GCCCGACTCCTGCAGGAGTCGGGC |
| 831 | GGGCGACTCACGCGTGAGTCGCCC | 1527 | GGGCGACTCCTGCAGGAGTCGCCC |
| 835 | GGGAGACTCACGCGTGAGTCTCCC | 1531 | GGGAGACTCCTGCAGGAGTCTCCC |
| 838 | GGGTGACTCACGCGTGAGTCACCC | 1534 | GGGTGACTCCTGCAGGAGTCACCC |
| 834 | GGACGACTCACGCGTGAGTCGTCC | 1530 | GGACGACTCCTGCAGGAGTCGTCC |
| 826 | GCACGACTCACGCGTGAGTCGTGC | 1522 | GCACGACTCCTGCAGGAGTCGTGC |
| 825 | GACCGACTCACGCGTGAGTCGGTC | 1521 | GACCGACTCCTGCAGGAGTCGGTC |
| 829 | GTCCGACTCACGCGTGAGTCGGAC | 1525 | GTCCGACTCCTGCAGGAGTCGGAC |
| 824 | ACCCGACTCACGCGTGAGTCGGGT | 1520 | ACCCGACTCCTGCAGGAGTCGGGT |
| 828 | TCCCGACTCACGCGTGAGTCGGGA | 1524 | TCCCGACTCCTGCAGGAGTCGGGA |
| 827 | GCCAGACTCACGCGTGAGTCTGGC | 1523 | GCCAGACTCCTGCAGGAGTCTGGC |
| 830 | GCCTGACTCACGCGTGAGTCAGGC | 1526 | GCCTGACTCCTGCAGGAGTCAGGC |
| 816 | GACGGACTCACGCGTGAGTCCGTC | 1512 | GACGGACTCCTGCAGGAGTCCGTC |
| 820 | GTCGGACTCACGCGTGAGTCCGAC | 1516 | GTCGGACTCCTGCAGGAGTCCGAC |
| 815 | AGCGGACTCACGCGTGAGTCCGCT | 1511 | AGCGGACTCCTGCAGGAGTCCGCT |
| 819 | TGCGGACTCACGCGTGAGTCCGCA | 1515 | TGCGGACTCCTGCAGGAGTCCGCA |
| 817 | GGAGGACTCACGCGTGAGTCCTCC | 1513 | GGAGGACTCCTGCAGGAGTCCTCC |
| 821 | GGTGGACTCACGCGTGAGTCCACC | 1517 | GGTGGACTCCTGCAGGAGTCCACC |
| 818 | GGCAGACTCACGCGTGAGTCTGCC | 1514 | GGCAGACTCCTGCAGGAGTCTGCC |

FIG. 8A (CONTINUED)

| | | | |
|---|---|---|---|
| 822 | GGCTGACTCACGCGTGAGTCAGCC | 1518 | GGCTGACTCCTGCAGGAGTCAGCC |
| 853 | CACGGACTCACGCGTGAGTCCGTG | 1549 | CACGGACTCCTGCAGGAGTCCGTG |
| 855 | CTCGGACTCACGCGTGAGTCCGAG | 1551 | CTCGGACTCCTGCAGGAGTCCGAG |
| 841 | CCAGGACTCACGCGTGAGTCCTGG | 1537 | CCAGGACTCCTGCAGGAGTCCTGG |
| 845 | CCTGGACTCACGCGTGAGTCCAGG | 1541 | CCTGGACTCCTGCAGGAGTCCAGG |
| 854 | CCCAGACTCACGCGTGAGTCTGGG | 1550 | CCCAGACTCCTGCAGGAGTCTGGG |
| 856 | CCCTGACTCACGCGTGAGTCAGGG | 1552 | CCCTGACTCCTGCAGGAGTCAGGG |
| 839 | ACGGGACTCACGCGTGAGTCCCGT | 1535 | ACGGGACTCCTGCAGGAGTCCCGT |
| 843 | TCGGGACTCACGCGTGAGTCCCGA | 1539 | TCGGGACTCCTGCAGGAGTCCCGA |
| 840 | CAGGGACTCACGCGTGAGTCCCTG | 1536 | CAGGGACTCCTGCAGGAGTCCCTG |
| 844 | CTGGGACTCACGCGTGAGTCCCAG | 1540 | CTGGGACTCCTGCAGGAGTCCCAG |
| | | | |
| 2264 | GGCGGACTCAGCGCTGAGTCCGCC | 1336 | GGCGGACTCGTCGACGAGTCCGCC |
| 2273 | GCCCGACTCAGCGCTGAGTCGGGC | 1345 | GCCCGACTCGTCGACGAGTCGGGC |
| 2281 | GGGCGACTCAGCGCTGAGTCGCCC | 1353 | GGGCGACTCGTCGACGAGTCGCCC |
| 2285 | GGGAGACTCAGCGCTGAGTCTCCC | 1357 | GGGAGACTCGTCGACGAGTCTCCC |
| 2288 | GGGTGACTCAGCGCTGAGTCACCC | 1360 | GGGTGACTCGTCGACGAGTCACCC |
| 2284 | GGACGACTCAGCGCTGAGTCGTCC | 1356 | GGACGACTCGTCGACGAGTCGTCC |
| 2276 | GCACGACTCAGCGCTGAGTCGTGC | 1348 | GCACGACTCGTCGACGAGTCGTGC |
| 2275 | GACCGACTCAGCGCTGAGTCGGTC | 1347 | GACCGACTCGTCGACGAGTCGGTC |
| 2279 | GTCCGACTCAGCGCTGAGTCGGAC | 1351 | GTCCGACTCGTCGACGAGTCGGAC |
| 2274 | ACCCGACTCAGCGCTGAGTCGGGT | 1346 | ACCCGACTCGTCGACGAGTCGGGT |
| 2278 | TCCCGACTCAGCGCTGAGTCGGGA | 1350 | TCCCGACTCGTCGACGAGTCGGGA |
| 2277 | GCCAGACTCAGCGCTGAGTCTGGC | 1349 | GCCAGACTCGTCGACGAGTCTGGC |
| 2280 | GCCTGACTCAGCGCTGAGTCAGGC | 1352 | GCCTGACTCGTCGACGAGTCAGGC |
| 2266 | GACGGACTCAGCGCTGAGTCCGTC | 1338 | GACGGACTCGTCGACGAGTCCGTC |
| 2270 | GTCGGACTCAGCGCTGAGTCCGAC | 1342 | GTCGGACTCGTCGACGAGTCCGAC |
| 2265 | AGCGGACTCAGCGCTGAGTCCGCT | 1337 | AGCGGACTCGTCGACGAGTCCGCT |
| 2269 | TGCGGACTCAGCGCTGAGTCCGCA | 1341 | TGCGGACTCGTCGACGAGTCCGCA |
| 2267 | GGAGGACTCAGCGCTGAGTCCTCC | 1339 | GGAGGACTCGTCGACGAGTCCTCC |
| 2271 | GGTGGACTCAGCGCTGAGTCCACC | 1343 | GGTGGACTCGTCGACGAGTCCACC |
| 2268 | GGCAGACTCAGCGCTGAGTCTGCC | 1340 | GGCAGACTCGTCGACGAGTCTGCC |
| 2272 | GGCTGACTCAGCGCTGAGTCAGCC | 1344 | GGCTGACTCGTCGACGAGTCAGCC |
| 2303 | CACGGACTCAGCGCTGAGTCCGTG | 1375 | CACGGACTCGTCGACGAGTCCGTG |
| 2305 | CTCGGACTCAGCGCTGAGTCCGAG | 1377 | CTCGGACTCGTCGACGAGTCCGAG |
| 2291 | CCAGGACTCAGCGCTGAGTCCTGG | 1363 | CCAGGACTCGTCGACGAGTCCTGG |
| 2295 | CCTGGACTCAGCGCTGAGTCCAGG | 1367 | CCTGGACTCGTCGACGAGTCCAGG |
| 2304 | CCCAGACTCAGCGCTGAGTCTGGG | 1376 | CCCAGACTCGTCGACGAGTCTGGG |
| 2306 | CCCTGACTCAGCGCTGAGTCAGGG | 1378 | CCCTGACTCGTCGACGAGTCAGGG |
| 2289 | ACGGGACTCAGCGCTGAGTCCCGT | 1361 | ACGGGACTCGTCGACGAGTCCCGT |
| 2293 | TCGGGACTCAGCGCTGAGTCCCGA | 1365 | TCGGGACTCGTCGACGAGTCCCGA |
| 2290 | CAGGGACTCAGCGCTGAGTCCCTG | 1362 | CAGGGACTCGTCGACGAGTCCCTG |
| 2294 | CTGGGACTCAGCGCTGAGTCCCAG | 1366 | CTGGGACTCGTCGACGAGTCCCAG |

FIG. 8A (CONTINUED)

| | | | |
|---|---|---|---|
| 872 | GGCGGACTCACCGGTGAGTCCGCC | 1336 | GGCGGACTCGTCGACGAGTCCGCC |
| 881 | GCCCGACTCACCGGTGAGTCGGGC | 1345 | GCCCGACTCGTCGACGAGTCGGGC |
| 889 | GGGCGACTCACCGGTGAGTCGCCC | 1353 | GGGCGACTCGTCGACGAGTCGCCC |
| 893 | GGGAGACTCACCGGTGAGTCTCCC | 1357 | GGGAGACTCGTCGACGAGTCTCCC |
| 896 | GGGTGACTCACCGGTGAGTCACCC | 1360 | GGGTGACTCGTCGACGAGTCACCC |
| 892 | GGACGACTCACCGGTGAGTCGTCC | 1356 | GGACGACTCGTCGACGAGTCGTCC |
| 884 | GCACGACTCACCGGTGAGTCGTGC | 1348 | GCACGACTCGTCGACGAGTCGTGC |
| 883 | GACCGACTCACCGGTGAGTCGGTC | 1347 | GACCGACTCGTCGACGAGTCGGTC |
| 887 | GTCCGACTCACCGGTGAGTCGGAC | 1351 | GTCCGACTCGTCGACGAGTCGGAC |
| 882 | ACCCGACTCACCGGTGAGTCGGGT | 1346 | ACCCGACTCGTCGACGAGTCGGGT |
| 886 | TCCCGACTCACCGGTGAGTCGGGA | 1350 | TCCCGACTCGTCGACGAGTCGGGA |
| 885 | GCCAGACTCACCGGTGAGTCTGGC | 1349 | GCCAGACTCGTCGACGAGTCTGGC |
| 888 | GCCTGACTCACCGGTGAGTCAGGC | 1352 | GCCTGACTCGTCGACGAGTCAGGC |
| 874 | GACGGACTCACCGGTGAGTCCGTC | 1338 | GACGGACTCGTCGACGAGTCCGTC |
| 878 | GTCGGACTCACCGGTGAGTCCGAC | 1342 | GTCGGACTCGTCGACGAGTCCGAC |
| 873 | AGCGGACTCACCGGTGAGTCCGCT | 1337 | AGCGGACTCGTCGACGAGTCCGCT |
| 877 | TGCGGACTCACCGGTGAGTCCGCA | 1341 | TGCGGACTCGTCGACGAGTCCGCA |
| 875 | GGAGGACTCACCGGTGAGTCCTCC | 1339 | GGAGGACTCGTCGACGAGTCCTCC |
| 879 | GGTGGACTCACCGGTGAGTCCACC | 1343 | GGTGGACTCGTCGACGAGTCCACC |
| 876 | GGCAGACTCACCGGTGAGTCTGCC | 1340 | GGCAGACTCGTCGACGAGTCTGCC |
| 880 | GGCTGACTCACCGGTGAGTCAGCC | 1344 | GGCTGACTCGTCGACGAGTCAGCC |
| 911 | CACGGACTCACCGGTGAGTCCGTG | 1375 | CACGGACTCGTCGACGAGTCCGTG |
| 913 | CTCGGACTCACCGGTGAGTCCGAG | 1377 | CTCGGACTCGTCGACGAGTCCGAG |
| 899 | CCAGGACTCACCGGTGAGTCCTGG | 1363 | CCAGGACTCGTCGACGAGTCCTGG |
| 15415 | CCTGGACTACCGGTGAGTCCAGG | 1367 | CCTGGACTCGTCGACGAGTCCAGG |
| 912 | CCCAGACTCACCGGTGAGTCTGGG | 1376 | CCCAGACTCGTCGACGAGTCTGGG |
| 914 | CCCTGACTCACCGGTGAGTCAGGG | 1378 | CCCTGACTCGTCGACGAGTCAGGG |
| 897 | ACGGGACTCACCGGTGAGTCCCGT | 1361 | ACGGGACTCGTCGACGAGTCCCGT |
| 901 | TCGGGACTCACCGGTGAGTCCCGA | 1365 | TCGGGACTCGTCGACGAGTCCCGA |
| 898 | CAGGGACTCACCGGTGAGTCCCTG | 1362 | CAGGGACTCGTCGACGAGTCCCTG |
| 902 | CTGGGACTCACCGGTGAGTCCCAG | 1366 | CTGGGACTCGTCGACGAGTCCCAG |

FIG. 8A (CONTINUED)

| SEQ ID NO: | | SEQ ID NO: | |
|---|---|---|---|
| 524 | GGCGGACTCGCTAGCGAGTCCGCC | 466 | GGCGGACTCGCATGCGAGTCCGCC |
| 533 | GCCCGACTCGCTAGCGAGTCGGGC | 475 | GCCCGACTCGCATGCGAGTCGGGC |
| 541 | GGGCGACTCGCTAGCGAGTCGCCC | 483 | GGGCGACTCGCATGCGAGTCGCCC |
| 545 | GGGAGACTCGCTAGCGAGTCTCCC | 487 | GGGAGACTCGCATGCGAGTCTCCC |
| 548 | GGGTGACTCGCTAGCGAGTCACCC | 490 | GGGTGACTCGCATGCGAGTCACCC |
| 544 | GGACGACTCGCTAGCGAGTCGTCC | 486 | GGACGACTCGCATGCGAGTCGTCC |
| 536 | GCACGACTCGCTAGCGAGTCGTGC | 478 | GCACGACTCGCATGCGAGTCGTGC |
| 535 | GACCGACTCGCTAGCGAGTCGGTC | 477 | GACCGACTCGCATGCGAGTCGGTC |
| 539 | GTCCGACTCGCTAGCGAGTCGGAC | 481 | GTCCGACTCGCATGCGAGTCGGAC |
| 534 | ACCCGACTCGCTAGCGAGTCGGGT | 476 | ACCCGACTCGCATGCGAGTCGGGT |
| 538 | TCCCGACTCGCTAGCGAGTCGGGA | 480 | TCCCGACTCGCATGCGAGTCGGGA |
| 537 | GCCAGACTCGCTAGCGAGTCTGGC | 479 | GCCAGACTCGCATGCGAGTCTGGC |
| 540 | GCCTGACTCGCTAGCGAGTCAGGC | 482 | GCCTGACTCGCATGCGAGTCAGGC |
| 526 | GACGGACTCGCTAGCGAGTCCGTC | 468 | GACGGACTCGCATGCGAGTCCGTC |
| 530 | GTCGGACTCGCTAGCGAGTCCGAC | 472 | GTCGGACTCGCATGCGAGTCCGAC |
| 525 | AGCGGACTCGCTAGCGAGTCCGCT | 467 | AGCGGACTCGCATGCGAGTCCGCT |
| 529 | TGCGGACTCGCTAGCGAGTCCGCA | 471 | TGCGGACTCGCATGCGAGTCCGCA |
| 527 | GGAGGACTCGCTAGCGAGTCCTCC | 469 | GGAGGACTCGCATGCGAGTCCTCC |
| 531 | GGTGGACTCGCTAGCGAGTCCACC | 473 | GGTGGACTCGCATGCGAGTCCACC |
| 528 | GGCAGACTCGCTAGCGAGTCTGCC | 470 | GGCAGACTCGCATGCGAGTCTGCC |
| 532 | GGCTGACTCGCTAGCGAGTCAGCC | 474 | GGCTGACTCGCATGCGAGTCAGCC |
| 563 | CACGGACTCGCTAGCGAGTCCGTG | 505 | CACGGACTCGCATGCGAGTCCGTG |
| 565 | CTCGGACTCGCTAGCGAGTCCGAG | 507 | CTCGGACTCGCATGCGAGTCCGAG |
| 551 | CCAGGACTCGCTAGCGAGTCCTGG | 493 | CCAGGACTCGCATGCGAGTCCTGG |
| 555 | CCTGGACTCGCTAGCGAGTCCAGG | 497 | CCTGGACTCGCATGCGAGTCCAGG |
| 564 | CCCAGACTCGCTAGCGAGTCTGGG | 506 | CCCAGACTCGCATGCGAGTCTGGG |
| 566 | CCCTGACTCGCTAGCGAGTCAGGG | 508 | CCCTGACTCGCATGCGAGTCAGGG |
| 549 | ACGGGACTCGCTAGCGAGTCCCGT | 491 | ACGGGACTCGCATGCGAGTCCCGT |
| 553 | TCGGGACTCGCTAGCGAGTCCCGA | 495 | TCGGGACTCGCATGCGAGTCCCGA |
| 550 | CAGGGACTCGCTAGCGAGTCCCTG | 492 | CAGGGACTCGCATGCGAGTCCCTG |
| 554 | CTGGGACTCGCTAGCGAGTCCCAG | 496 | CTGGGACTCGCATGCGAGTCCCAG |
| | | | |
| 15454 | CCGGGACTCCACGTGGAGTCCCGG | 15492 | CCGGGACTCCGTACGGAGTCCCGG |
| 15455 | CCCGGACTCCACGTGGAGTCCGGG | 15493 | CCCGGACTCCGTACGGAGTCCGGG |
| 1800 | GGCGGACTCCACGTGGAGTCCGCC | 60 | GGCGGACTCCGTACGGAGTCCGCC |
| 15456 | GCCGGACTCCACGTGGAGTCCGGC | 15494 | GCCGGACTCCGTACGGAGTCCGGC |

FIG. 8A (CONTINUED)

| | | | |
|---|---|---|---|
| 1809 | GCCCGACTCCACGTGGAGTCGGGC | 69 | GCCCGACTCCGTACGGAGTCGGGC |
| 15457 | GGCCGACTCCACGTGGAGTCGGCC | 15495 | GGCCGACTCCGTACGGAGTCGGCC |
| 1817 | GGGCGACTCCACGTGGAGTCGCCC | 77 | GGGCGACTCCGTACGGAGTCGCCC |
| 1821 | GGGAGACTCCACGTGGAGTCTCCC | 81 | GGGAGACTCCGTACGGAGTCTCCC |
| 1824 | GGGTGACTCCACGTGGAGTCACCC | 84 | GGGTGACTCCGTACGGAGTCACCC |
| 1820 | GGACGACTCCACGTGGAGTCGTCC | 80 | GGACGACTCCGTACGGAGTCGTCC |
| 15458 | GGTCGACTCCACGTGGAGTCGACC | 15496 | GGTCGACTCCGTACGGAGTCGACC |
| 1812 | GCACGACTCCACGTGGAGTCGTGC | 72 | GCACGACTCCGTACGGAGTCGTGC |
| 15459 | GCTCGACTCCACGTGGAGTCGAGC | 15497 | GCTCGACTCCGTACGGAGTCGAGC |
| 1811 | GACCGACTCCACGTGGAGTCGGTC | 71 | GACCGACTCCGTACGGAGTCGGTC |
| 1815 | GTCCGACTCCACGTGGAGTCGGAC | 75 | GTCCGACTCCGTACGGAGTCGGAC |
| 1810 | ACCCGACTCCACGTGGAGTCGGGT | 70 | ACCCGACTCCGTACGGAGTCGGGT |
| 1814 | TCCCGACTCCACGTGGAGTCGGGA | 74 | TCCCGACTCCGTACGGAGTCGGGA |
| 1813 | GCCAGACTCCACGTGGAGTCTGGC | 73 | GCCAGACTCCGTACGGAGTCTGGC |
| 1816 | GCCTGACTCCACGTGGAGTCAGGC | 76 | GCCTGACTCCGTACGGAGTCAGGC |
| 1802 | GACGGACTCCACGTGGAGTCCGTC | 62 | GACGGACTCCGTACGGAGTCCGTC |
| 1806 | GTCGGACTCCACGTGGAGTCCGAC | 66 | GTCGGACTCCGTACGGAGTCCGAC |
| 15460 | ACCGGACTCCACGTGGAGTCCGGT | 15498 | ACCGGACTCCGTACGGAGTCCGGT |
| 15461 | TCCGGACTCCACGTGGAGTCCGGA | 15499 | TCCGGACTCCGTACGGAGTCCGGA |
| 1801 | AGCGGACTCCACGTGGAGTCCGCT | 61 | AGCGGACTCCGTACGGAGTCCGCT |
| 1805 | TGCGGACTCCACGTGGAGTCCGCA | 65 | TGCGGACTCCGTACGGAGTCCGCA |
| 1803 | GGAGGACTCCACGTGGAGTCCTCC | 63 | GGAGGACTCCGTACGGAGTCCTCC |
| 1807 | GGTGGACTCCACGTGGAGTCCACC | 67 | GGTGGACTCCGTACGGAGTCCACC |
| 1804 | GGCAGACTCCACGTGGAGTCTGCC | 64 | GGCAGACTCCGTACGGAGTCTGCC |
| 1808 | GGCTGACTCCACGTGGAGTCAGCC | 68 | GGCTGACTCCGTACGGAGTCAGCC |
| 1839 | CACGGACTCCACGTGGAGTCCGTG | 99 | CACGGACTCCGTACGGAGTCCGTG |
| 1841 | CTCGGACTCCACGTGGAGTCCGAG | 101 | CTCGGACTCCGTACGGAGTCCGAG |
| 1827 | CCAGGACTCCACGTGGAGTCCTGG | 87 | CCAGGACTCCGTACGGAGTCCTGG |
| 1831 | CCTGGACTCCACGTGGAGTCCAGG | 91 | CCTGGACTCCGTACGGAGTCCAGG |
| 1840 | CCCAGACTCCACGTGGAGTCTGGG | 100 | CCCAGACTCCGTACGGAGTCTGGG |
| 1842 | CCCTGACTCCACGTGGAGTCAGGG | 102 | CCCTGACTCCGTACGGAGTCAGGG |
| 1825 | ACGGGACTCCACGTGGAGTCCCGT | 85 | ACGGGACTCCGTACGGAGTCCCGT |
| 1829 | TCGGGACTCCACGTGGAGTCCCGA | 89 | TCGGGACTCCGTACGGAGTCCCGA |
| 1826 | CAGGGACTCCACGTGGAGTCCCTG | 86 | CAGGGACTCCGTACGGAGTCCCTG |
| 1830 | CTGGGACTCCACGTGGAGTCCCAG | 90 | CTGGGACTCCGTACGGAGTCCCAG |
| | | | |
| 930 | GGCGGACTCCCATGGGAGTCCGCC | 15500 | CCGGGACTCCGATCGGAGTCCCGG |
| 939 | GCCCGACTCCCATGGGAGTCGGGC | 15501 | CCCGGACTCCGATCGGAGTCCGGG |
| 947 | GGGCGACTCCCATGGGAGTCGCCC | 2 | GGCGGACTCCGATCGGAGTCCGCC |
| 951 | GGGAGACTCCCATGGGAGTCTCCC | 15502 | GCCGGACTCCGATCGGAGTCCGGC |
| 954 | GGGTGACTCCCATGGGAGTCACCC | 11 | GCCCGACTCCGATCGGAGTCGGGC |
| 950 | GGACGACTCCCATGGGAGTCGTCC | 15503 | GGCCGACTCCGATCGGAGTCGGCC |
| 942 | GCACGACTCCCATGGGAGTCGTGC | 19 | GGGCGACTCCGATCGGAGTCGCCC |
| 941 | GACCGACTCCCATGGGAGTCGGTC | 23 | GGGAGACTCCGATCGGAGTCTCCC |

FIG. 8A (CONTINUED)

| | | | |
|---|---|---|---|
| 945 | GTCCGACTCCCATGGGAGTCGGAC | 26 | GGGTGACTCCGATCGGAGTCACCC |
| 940 | ACCCGACTCCCATGGGAGTCGGGT | 22 | GGACGACTCCGATCGGAGTCGTCC |
| 944 | TCCCGACTCCCATGGGAGTCGGGA | 15504 | GGTCGACTCCGATCGGAGTCGACC |
| 943 | GCCAGACTCCCATGGGAGTCTGGC | 14 | GCACGACTCCGATCGGAGTCGTGC |
| 946 | GCCTGACTCCCATGGGAGTCAGGC | 15505 | GCTCGACTCCGATCGGAGTCGAGC |
| 932 | GACGGACTCCCATGGGAGTCCGTC | 13 | GACCGACTCCGATCGGAGTCGGTC |
| 936 | GTCGGACTCCCATGGGAGTCCGAC | 17 | GTCCGACTCCGATCGGAGTCGGAC |
| 931 | AGCGGACTCCCATGGGAGTCCGCT | 12 | ACCCGACTCCGATCGGAGTCGGGT |
| 935 | TGCGGACTCCCATGGGAGTCCGCA | 16 | TCCCGACTCCGATCGGAGTCGGGA |
| 933 | GGAGGACTCCCATGGGAGTCCTCC | 15 | GCCAGACTCCGATCGGAGTCTGGC |
| 937 | GGTGGACTCCCATGGGAGTCCACC | 18 | GCCTGACTCCGATCGGAGTCAGGC |
| 934 | GGCAGACTCCCATGGGAGTCTGCC | 4 | GACGGACTCCGATCGGAGTCCGTC |
| 938 | GGCTGACTCCCATGGGAGTCAGCC | 8 | GTCGGACTCCGATCGGAGTCCGAC |
| 969 | CACGGACTCCCATGGGAGTCCGTG | 15506 | ACCGGACTCCGATCGGAGTCCGGT |
| 971 | CTCGGACTCCCATGGGAGTCCGAG | 15507 | TCCGGACTCCGATCGGAGTCCGGA |
| 957 | CCAGGACTCCCATGGGAGTCCTGG | 3 | AGCGGACTCCGATCGGAGTCCGCT |
| 961 | CCTGGACTCCCATGGGAGTCCAGG | 7 | TGCGGACTCCGATCGGAGTCCGCA |
| 970 | CCCAGACTCCCATGGGAGTCTGGG | 5 | GGAGGACTCCGATCGGAGTCCTCC |
| 972 | CCCTGACTCCCATGGGAGTCAGGG | 9 | GGTGGACTCCGATCGGAGTCCACC |
| 955 | ACGGGACTCCCATGGGAGTCCCGT | 6 | GGCAGACTCCGATCGGAGTCTGCC |
| 959 | TCGGGACTCCCATGGGAGTCCCGA | 10 | GGCTGACTCCGATCGGAGTCAGCC |
| 956 | CAGGGACTCCCATGGGAGTCCCTG | 41 | CACGGACTCCGATCGGAGTCCGTG |
| 960 | CTGGGACTCCCATGGGAGTCCCAG | 43 | CTCGGACTCCGATCGGAGTCCGAG |
| | | 29 | CCAGGACTCCGATCGGAGTCCTGG |
| 15462 | GCCCGACTCGGATCCGAGTCGGGC | 33 | CCTGGACTCCGATCGGAGTCCAGG |
| 15462 | GCCCGACTCGGATCCGAGTCGGGC | 42 | CCCAGACTCCGATCGGAGTCTGGG |
| 15463 | GGGCGACTCGGATCCGAGTCGCCC | 44 | CCCTGACTCCGATCGGAGTCAGGG |
| 15464 | GGGAGACTCGGATCCGAGTCTCCC | 27 | ACGGGACTCCGATCGGAGTCCCGT |
| 15465 | GGGTGACTCGGATCCGAGTCACCC | 31 | TCGGGACTCCGATCGGAGTCCCGA |
| 15466 | GGACGACTCGGATCCGAGTCGTCC | 28 | CAGGGACTCCGATCGGAGTCCCTG |
| 15467 | GCACGACTCGGATCCGAGTCGTGC | 32 | CTGGGACTCCGATCGGAGTCCCAG |
| 15468 | GACCGACTCGGATCCGAGTCGGTC | | |
| 15469 | GTCCGACTCGGATCCGAGTCGGAC | 466 | GGCGGACTCGCATGCGAGTCCGCC |
| 15470 | ACCCGACTCGGATCCGAGTCGGGT | 475 | GCCCGACTCGCATGCGAGTCGGGC |
| 15471 | TCCCGACTCGGATCCGAGTCGGGA | 483 | GGGCGACTCGCATGCGAGTCGCCC |
| 15472 | GCCAGACTCGGATCCGAGTCTGGC | 487 | GGGAGACTCGCATGCGAGTCTCCC |
| 15473 | GCCTGACTCGGATCCGAGTCAGGC | 490 | GGGTGACTCGCATGCGAGTCACCC |
| 15474 | GACGGACTCGGATCCGAGTCCGTC | 486 | GGACGACTCGCATGCGAGTCGTCC |
| 15475 | GTCGGACTCGGATCCGAGTCCGAC | 478 | GCACGACTCGCATGCGAGTCGTGC |
| 15476 | AGCGGACTCGGATCCGAGTCCGCT | 477 | GACCGACTCGCATGCGAGTCGGTC |
| 15477 | TGCGGACTCGGATCCGAGTCCGCA | 481 | GTCCGACTCGCATGCGAGTCGGAC |
| 15478 | GGAGGACTCGGATCCGAGTCCTCC | 476 | ACCCGACTCGCATGCGAGTCGGGT |
| 15479 | GGTGGACTCGGATCCGAGTCCACC | 480 | TCCCGACTCGCATGCGAGTCGGGA |
| 15480 | GGCAGACTCGGATCCGAGTCTGCC | 479 | GCCAGACTCGCATGCGAGTCTGGC |

FIG. 8A (CONTINUED)

| | | | |
|---|---|---|---|
| 15481 | GGCTGACTCGGATCCGAGTCAGCC | 482 | GCCTGACTCGCATGCGAGTCAGGC |
| 15482 | CACGGACTCGGATCCGAGTCCGTG | 468 | GACGGACTCGCATGCGAGTCCGTC |
| 15483 | CTCGGACTCGGATCCGAGTCCGAG | 472 | GTCGGACTCGCATGCGAGTCCGAC |
| 15484 | CCAGGACTCGGATCCGAGTCCTGG | 467 | AGCGGACTCGCATGCGAGTCCGCT |
| 15485 | CCTGGACTCGGATCCGAGTCCAGG | 471 | TGCGGACTCGCATGCGAGTCCGCA |
| 15486 | CCCAGACTCGGATCCGAGTCTGGG | 469 | GGAGGACTCGCATGCGAGTCCTCC |
| 15487 | CCCTGACTCGGATCCGAGTCAGGG | 473 | GGTGGACTCGCATGCGAGTCCACC |
| 15488 | ACGGGACTCGGATCCGAGTCCCGT | 470 | GGCAGACTCGCATGCGAGTCTGCC |
| 15489 | TCGGGACTCGGATCCGAGTCCCGA | 474 | GGCTGACTCGCATGCGAGTCAGCC |
| 15490 | CAGGGACTCGGATCCGAGTCCCTG | 505 | CACGGACTCGCATGCGAGTCCGTG |
| 15491 | CTGGGACTCGGATCCGAGTCCCAG | 507 | CTCGGACTCGCATGCGAGTCCGAG |
| | | 493 | CCAGGACTCGCATGCGAGTCCTGG |
| 524 | GGCGGACTCGCTAGCGAGTCCGCC | 497 | CCTGGACTCGCATGCGAGTCCAGG |
| 533 | GCCCGACTCGCTAGCGAGTCGGGC | 506 | CCCAGACTCGCATGCGAGTCTGGG |
| 541 | GGGCGACTCGCTAGCGAGTCGCCC | 508 | CCCTGACTCGCATGCGAGTCAGGG |
| 545 | GGGAGACTCGCTAGCGAGTCTCCC | 491 | ACGGGACTCGCATGCGAGTCCCGT |
| 548 | GGGTGACTCGCTAGCGAGTCACCC | 495 | TCGGGACTCGCATGCGAGTCCCGA |
| 544 | GGACGACTCGCTAGCGAGTCGTCC | 492 | CAGGGACTCGCATGCGAGTCCCTG |
| 536 | GCACGACTCGCTAGCGAGTCGTGC | 496 | CTGGGACTCGCATGCGAGTCCCAG |
| 535 | GACCGACTCGCTAGCGAGTCGGTC | | |
| 539 | GTCCGACTCGCTAGCGAGTCGGAC | 1742 | GGCGGACTCCAGCTGGAGTCCGCC |
| 534 | ACCCGACTCGCTAGCGAGTCGGGT | 1751 | GCCCGACTCCAGCTGGAGTCGGGC |
| 538 | TCCCGACTCGCTAGCGAGTCGGGA | 1759 | GGGCGACTCCAGCTGGAGTCGCCC |
| 537 | GCCAGACTCGCTAGCGAGTCTGGC | 1763 | GGGAGACTCCAGCTGGAGTCTCCC |
| 540 | GCCTGACTCGCTAGCGAGTCAGGC | 1766 | GGGTGACTCCAGCTGGAGTCACCC |
| 526 | GACGGACTCGCTAGCGAGTCCGTC | 1762 | GGACGACTCCAGCTGGAGTCGTCC |
| 530 | GTCGGACTCGCTAGCGAGTCCGAC | 1754 | GCACGACTCCAGCTGGAGTCGTGC |
| 525 | AGCGGACTCGCTAGCGAGTCCGCT | 1753 | GACCGACTCCAGCTGGAGTCGGTC |
| 529 | TGCGGACTCGCTAGCGAGTCCGCA | 1757 | GTCCGACTCCAGCTGGAGTCGGAC |
| 527 | GGAGGACTCGCTAGCGAGTCCTCC | 1752 | ACCCGACTCCAGCTGGAGTCGGGT |
| 531 | GGTGGACTCGCTAGCGAGTCCACC | 1756 | TCCCGACTCCAGCTGGAGTCGGGA |
| 528 | GGCAGACTCGCTAGCGAGTCTGCC | 1755 | GCCAGACTCCAGCTGGAGTCTGGC |
| 532 | GGCTGACTCGCTAGCGAGTCAGCC | 1758 | GCCTGACTCCAGCTGGAGTCAGGC |
| 563 | CACGGACTCGCTAGCGAGTCCGTG | 1744 | GACGGACTCCAGCTGGAGTCCGTC |
| 565 | CTCGGACTCGCTAGCGAGTCCGAG | 1748 | GTCGGACTCCAGCTGGAGTCCGAC |
| 551 | CCAGGACTCGCTAGCGAGTCCTGG | 1743 | AGCGGACTCCAGCTGGAGTCCGCT |
| 555 | CCTGGACTCGCTAGCGAGTCCAGG | 1747 | TGCGGACTCCAGCTGGAGTCCGCA |
| 564 | CCCAGACTCGCTAGCGAGTCTGGG | 1745 | GGAGGACTCCAGCTGGAGTCCTCC |
| 566 | CCCTGACTCGCTAGCGAGTCAGGG | 1749 | GGTGGACTCCAGCTGGAGTCCACC |
| 549 | ACGGGACTCGCTAGCGAGTCCCGT | 1746 | GGCAGACTCCAGCTGGAGTCTGCC |
| 553 | TCGGGACTCGCTAGCGAGTCCCGA | 1750 | GGCTGACTCCAGCTGGAGTCAGCC |
| 550 | CAGGGACTCGCTAGCGAGTCCCTG | 1781 | CACGGACTCCAGCTGGAGTCCGTG |
| 554 | CTGGGACTCGCTAGCGAGTCCCAG | 1783 | CTCGGACTCCAGCTGGAGTCCGAG |
| 1767 | ACGGGACTCCAGCTGGAGTCCCGT | 1769 | CCAGGACTCCAGCTGGAGTCCTGG |

FIG. 8A (CONTINUED)

| | | | |
|---|---|---|---|
| 1771 | TCGGGACTCCAGCTGGAGTCCCGA | 1773 | CCTGGACTCCAGCTGGAGTCCAGG |
| 1768 | CAGGGACTCCAGCTGGAGTCCCTG | 1782 | CCCAGACTCCAGCTGGAGTCTGGG |
| 1772 | CTGGGACTCCAGCTGGAGTCCCAG | 1784 | CCCTGACTCCAGCTGGAGTCAGGG |

FIG. 8A (CONTINUED)

Sequences of 5'-tails
NNNNGACTCNNNNGAGTCNNNN (SEQ ID NO: 15258)
200 Selected Sequences = 0.08% of entire sequence space (248832)
ΔG = -47 Kcal/mole to -55 kcal/mole             ΔΔG < -40 kcal/mole
GC content 72% to 82%

| SEQ ID NO: | | SEQ ID NO: | |
|---|---|---|---|
| 10411 | GGCGGACTCCGCGGAGTCCGCC | 10469 | GGCGGACTCTGCAGAGTCCGCC |
| 10420 | GCCCGACTCCGCGGAGTCGGGC | 10478 | GCCCGACTCTGCAGAGTCGGGC |
| 10428 | GGGCGACTCCGCGGAGTCGCCC | 10486 | GGGCGACTCTGCAGAGTCGCCC |
| 15516 | CCGGGACTCCGCGGAGTCCCGG | 15521 | CCGGGACTCTGCAGAGTCCCGG |
| 15517 | CCCGGACTCCGCGGAGTCCGGG | 15522 | CCCGGACTCTGCAGAGTCCGGG |
| 15518 | GCCGGACTCCGCGGAGTCCGGC | 15523 | GCCGGACTCTGCAGAGTCCGGC |
| 15519 | GGCCGACTCCGCGGAGTCGGCC | 15524 | GGCCGACTCTGCAGAGTCGGCC |
| 10548 | GGGAGACTCGCGCGAGTCTCCC | 10991 | GGCGGACTCAGCTGAGTCCGCC |
| 10435 | GGGTGACTCCGCGGAGTCACCC | 11000 | GCCCGACTCAGCTGAGTCGGGC |
| 10431 | GGACGACTCCGCGGAGTCGTCC | 11008 | GGGCGACTCAGCTGAGTCGCCC |
| 10423 | GCACGACTCCGCGGAGTCGTGC | 15525 | CCGGGACTCAGCTGAGTCCCGG |
| 10422 | GACCGACTCCGCGGAGTCGGTC | 15526 | CCCGGACTCAGCTGAGTCCGGG |
| 10426 | GTCCGACTCCGCGGAGTCGGAC | 15527 | GCCGGACTCAGCTGAGTCCGGC |
| 10421 | ACCCGACTCCGCGGAGTCGGGT | 15528 | GGCCGACTCAGCTGAGTCGGCC |
| 10425 | TCCCGACTCCGCGGAGTCGGGA | 10817 | GGCGGACTCCTAGGAGTCCGCC |
| 10424 | GCCAGACTCCGCGGAGTCTGGC | 10826 | GCCCGACTCCTAGGAGTCGGGC |
| 10427 | GCCTGACTCCGCGGAGTCAGGC | 10834 | GGGCGACTCCTAGGAGTCGCCC |
| 10413 | GACGGACTCCGCGGAGTCCGTC | 15529 | CCGGGACTCCTAGGAGTCCCGG |
| 10417 | GTCGGACTCCGCGGAGTCCGAC | 15530 | CCCGGACTCCTAGGAGTCCGGG |
| 10412 | AGCGGACTCCGCGGAGTCCGCT | 15531 | GCCGGACTCCTAGGAGTCCGGC |
| 10416 | TGCGGACTCCGCGGAGTCCGCA | 15532 | GGCCGACTCCTAGGAGTCGGCC |
| 10414 | GGAGGACTCCGCGGAGTCCTCC | 10875 | GGCGGACTCCATGGAGTCCGCC |
| 10418 | GGTGGACTCCGCGGAGTCCACC | 10884 | GCCCGACTCCATGGAGTCGGGC |
| 10415 | GGCAGACTCCGCGGAGTCTGCC | 10892 | GGGCGACTCCATGGAGTCGCCC |
| 10419 | GGCTGACTCCGCGGAGTCAGCC | 15533 | CCGGGACTCCATGGAGTCCCGG |
| 10450 | CACGGACTCCGCGGAGTCCGTG | 15534 | CCCGGACTCCATGGAGTCCGGG |
| 10452 | CTCGGACTCCGCGGAGTCCGAG | 15535 | GCCGGACTCCATGGAGTCCGGC |
| 10438 | CCAGGACTCCGCGGAGTCCTGG | 15536 | GGCCGACTCCATGGAGTCGGCC |
| 10442 | CCTGGACTCCGCGGAGTCCAGG | 15537 | CCGGGACTCGCGCGAGTCCCGG |
| 10451 | CCCAGACTCCGCGGAGTCTGGG | 15538 | CCCGGACTCGCGCGAGTCCGGG |
| 10453 | CCCTGACTCCGCGGAGTCAGGG | 10527 | GGCGGACTCGCGCGAGTCCGCC |
| 10436 | ACGGGACTCCGCGGAGTCCCGT | 15539 | GCCGGACTCGCGCGAGTCCGGC |
| 10440 | TCGGGACTCCGCGGAGTCCCGA | 10536 | GCCCGACTCGCGCGAGTCGGGC |
| 10437 | CAGGGACTCCGCGGAGTCCCTG | 15540 | GGCCGACTCGCGCGAGTCGGCC |
| 10441 | CTGGGACTCCGCGGAGTCCCAG | 10544 | GGGCGACTCGCGCGAGTCGCCC |
| 15520 | ACCGGACTCCGCGGAGTCCGGT | 10548 | GGGAGACTCGCGCGAGTCTCCC |

FIG. 8B

| SEQ ID NO: | | SEQ ID NO: | |
|---|---|---|---|
| 10551 | GGGTGACTCGCGCGAGTCACCC | 15547 | CCCGGACTCACGTGAGTCCGGG |
| 10547 | GGACGACTCGCGCGAGTCGTCC | 10585 | GGCGGACTCACGTGAGTCCGCC |
| 10539 | GCACGACTCGCGCGAGTCGTGC | 15548 | GCCGGACTCACGTGAGTCCGGC |
| 10538 | GACCGACTCGCGCGAGTCGGTC | 10594 | GCCCGACTCACGTGAGTCGGGC |
| 10542 | GTCCGACTCGCGCGAGTCGGAC | 15549 | GGCCGACTCACGTGAGTCGGCC |
| 10537 | ACCCGACTCGCGCGAGTCGGGT | 10602 | GGGCGACTCACGTGAGTCGCCC |
| 10541 | TCCCGACTCGCGCGAGTCGGGA | 15550 | CCGGGACTCGTACGAGTCCCGG |
| 10540 | GCCAGACTCGCGCGAGTCTGGC | 15551 | CCCGGACTCGTACGAGTCCGGG |
| 10543 | GCCTGACTCGCGCGAGTCAGGC | 10759 | GGCGGACTCGTACGAGTCCGCC |
| 10529 | GACGGACTCGCGCGAGTCCGTC | 15552 | GCCGGACTCGTACGAGTCCGGC |
| 10533 | GTCGGACTCGCGCGAGTCCGAC | 10768 | GCCCGACTCGTACGAGTCGGGC |
| 15541 | ACCGGACTCGCGCGAGTCCGGT | 15553 | GGCCGACTCGTACGAGTCGGCC |
| 10528 | AGCGGACTCGCGCGAGTCCGCT | 10776 | GGGCGACTCGTACGAGTCGCCC |
| 10532 | TGCGGACTCGCGCGAGTCCGCA | 15554 | CCGGGACTCGATCGAGTCCCGG |
| 10530 | GGAGGACTCGCGCGAGTCCTCC | 15555 | CCCGGACTCGATCGAGTCCGGG |
| 10534 | GGTGGACTCGCGCGAGTCCACC | 15556 | GGCGGACTCGATCGAGTCCGCC |
| 10531 | GGCAGACTCGCGCGAGTCTGCC | 15557 | GCCGGACTCGATCGAGTCCGGC |
| 10535 | GGCTGACTCGCGCGAGTCAGCC | 15558 | GCCCGACTCGATCGAGTCGGGC |
| 10566 | CACGGACTCGCGCGAGTCCGTG | 15559 | GGCCGACTCGATCGAGTCGGCC |
| 10568 | CTCGGACTCGCGCGAGTCCGAG | 15560 | GGGCGACTCGATCGAGTCGCCC |
| 10554 | CCAGGACTCGCGCGAGTCCTGG | 10643 | GGCGGACTCGGCCGAGTCCGCC |
| 10558 | CCTGGACTCGCGCGAGTCCAGG | 10652 | GCCCGACTCGGCCGAGTCGGGC |
| 10567 | CCCAGACTCGCGCGAGTCTGGG | 10660 | GGGCGACTCGGCCGAGTCGCCC |
| 10569 | CCCTGACTCGCGCGAGTCAGGG | 15561 | CCGGGACTCGGCCGAGTCCCGG |
| 10552 | ACGGGACTCGCGCGAGTCCCGT | 15562 | CCCGGACTCGGCCGAGTCCGGG |
| 10556 | TCGGGACTCGCGCGAGTCCCGA | 15563 | GCCGGACTCGGCCGAGTCCGGC |
| 10553 | CAGGGACTCGCGCGAGTCCCTG | 15564 | GGCCGACTCGGCCGAGTCGGCC |
| 10557 | CTGGGACTCGCGCGAGTCCCAG | 10664 | GGGAGACTCGGCCGAGTCTCCC |
| 15542 | CCGGGACTCTCGAGAGTCCCGG | 10667 | GGGTGACTCGGCCGAGTCACCC |
| 15543 | CCCGGACTCTCGAGAGTCCGGG | 10663 | GGACGACTCGGCCGAGTCGTCC |
| 10933 | GGCGGACTCTCGAGAGTCCGCC | 10655 | GCACGACTCGGCCGAGTCGTGC |
| 15544 | GCCGGACTCTCGAGAGTCCGGC | 10654 | GACCGACTCGGCCGAGTCGGTC |
| 10942 | GCCCGACTCTCGAGAGTCGGGC | 10658 | GTCCGACTCGGCCGAGTCGGAC |
| 15545 | GGCCGACTCTCGAGAGTCGGCC | 10653 | ACCCGACTCGGCCGAGTCGGGT |
| 10950 | GGGCGACTCTCGAGAGTCGCCC | 10657 | TCCCGACTCGGCCGAGTCGGGA |
| 15546 | CCGGGACTCACGTGAGTCCCGG | 10656 | GCCAGACTCGGCCGAGTCTGGC |

FIG. 8B (CONTINUED)

| SEQ ID NO: | | SEQ ID NO: | |
|---|---|---|---|
| 10659 | GCCTGACTCGGCCGAGTCAGGC | 10717 | GCCTGACTCCCGGGAGTCAGGC |
| 10645 | GACGGACTCGGCCGAGTCCGTC | 10703 | GACGGACTCCCGGGAGTCCGTC |
| 10649 | GTCGGACTCGGCCGAGTCCGAC | 10707 | GTCGGACTCCCGGGAGTCCGAC |
| 10644 | AGCGGACTCGGCCGAGTCCGCT | 10702 | AGCGGACTCCCGGGAGTCCGCT |
| 10648 | TGCGGACTCGGCCGAGTCCGCA | 10706 | TGCGGACTCCCGGGAGTCCGCA |
| 10646 | GGAGGACTCGGCCGAGTCCTCC | 10704 | GGAGGACTCCCGGGAGTCCTCC |
| 10650 | GGTGGACTCGGCCGAGTCCACC | 10708 | GGTGGACTCCCGGGAGTCCACC |
| 10647 | GGCAGACTCGGCCGAGTCTGCC | 10705 | GGCAGACTCCCGGGAGTCTGCC |
| 10651 | GGCTGACTCGGCCGAGTCAGCC | 10709 | GGCTGACTCCCGGGAGTCAGCC |
| 10682 | CACGGACTCGGCCGAGTCCGTG | 10740 | CACGGACTCCCGGGAGTCCGTG |
| 10684 | CTCGGACTCGGCCGAGTCCGAG | 10742 | CTCGGACTCCCGGGAGTCCGAG |
| 10670 | CCAGGACTCGGCCGAGTCCTGG | 10728 | CCAGGACTCCCGGGAGTCCTGG |
| 10674 | CCTGGACTCGGCCGAGTCCAGG | 10732 | CCTGGACTCCCGGGAGTCCAGG |
| 10683 | CCCAGACTCGGCCGAGTCTGGG | 10741 | CCCAGACTCCCGGGAGTCTGGG |
| 10685 | CCCTGACTCGGCCGAGTCAGGG | 10743 | CCCTGACTCCCGGGAGTCAGGG |
| 10668 | ACGGGACTCGGCCGAGTCCCGT | 10726 | ACGGGACTCCCGGGAGTCCCGT |
| 10672 | TCGGGACTCGGCCGAGTCCCGA | 10730 | TCGGGACTCCCGGGAGTCCCGA |
| 10669 | CAGGGACTCGGCCGAGTCCCTG | 10727 | CAGGGACTCCCGGGAGTCCCTG |
| 10673 | CTGGGACTCGGCCGAGTCCCAG | 10731 | CTGGGACTCCCGGGAGTCCCAG |
| 15565 | ACCGGACTCGGCCGAGTCCGGT | 15570 | ACCGGACTCCCGGGAGTCCGGT |
| 10701 | GGCGGACTCCCGGGAGTCCGCC | | |
| 10710 | GCCGACTCCCGGGAGTCGGGC | | |
| 10718 | GGGCGACTCCCGGGAGTCGCCC | | |
| 15566 | CCGGGACTCCCGGGAGTCCCGG | | |
| 15567 | CCCGGACTCCCGGGAGTCCGGG | | |
| 15568 | GCCGGACTCCCGGGAGTCCGGC | | |
| 15569 | GGCCGACTCCCGGGAGTCGGCC | | |
| 10722 | GGGAGACTCCCGGGAGTCTCCC | | |
| 10725 | GGGTGACTCCCGGGAGTCACCC | | |
| 10721 | GGACGACTCCCGGGAGTCGTCC | | |
| 10713 | GCACGACTCCCGGGAGTCGTGC | | |
| 10712 | GACCGACTCCCGGGAGTCGGTC | | |
| 10716 | GTCCGACTCCCGGGAGTCGGAC | | |
| 10711 | ACCCGACTCCCGGGAGTCGGGT | | |
| 10715 | TCCCGACTCCCGGGAGTCGGGA | | |
| 10714 | GCCAGACTCCCGGGAGTCTGGC | | |

FIG. 8B (CONTINUED)

Design of an Isothermal DNA Amplification Assay for Soy Lectin From a Single Pair of Predicted Optimal Primer Structures without Screening a Multitude of Candidate Primer Combinations of Unknown Performance

- Assay target sequence in Soy Lectin gene selected based on absence of SNP's a 30 to 60 bp sequence window:
- 5'-ccaaggtctcattacctatgatgcctccaccagcctcttgttgttcttctttgittaccctttcacagagaa-3'
- Underlined are the sequence regions selected for design of the forward and reverse primers, respectively.
- Target binding region of Fwd primer: 5' –ATTACCTATGATGCC–3'
- $\Delta G_{25°C}$ of fwd Primer-Target Hybrid (PTH) = -25.99 kcal/mole; $\Delta G_{25°C}$ of Primer-Target binding region self dimer (PTBRHD) = -3.14 kcal/mole; $\Delta\Delta G_{25°C} = \Delta G_{PTH} - \Delta G_{PTBRHD} = -22.85$ kcal/mole
- Target binding region of Rev primer: 5' –ACCAAAGAAGCAAC–3'
- $\Delta G_{25°C}$ of rev Primer-Target Hybrid (PTH) = -25.35 kcal/mole; $\Delta G_{25°C}$ of Primer-Target binding region self dimer (PTBRHD) = -3.14 kcal/mole; $\Delta\Delta G_{25°C} = \Delta G_{PTH} - \Delta G_{PTBRHD} = -22.21$ kcal/mole

Figure 12

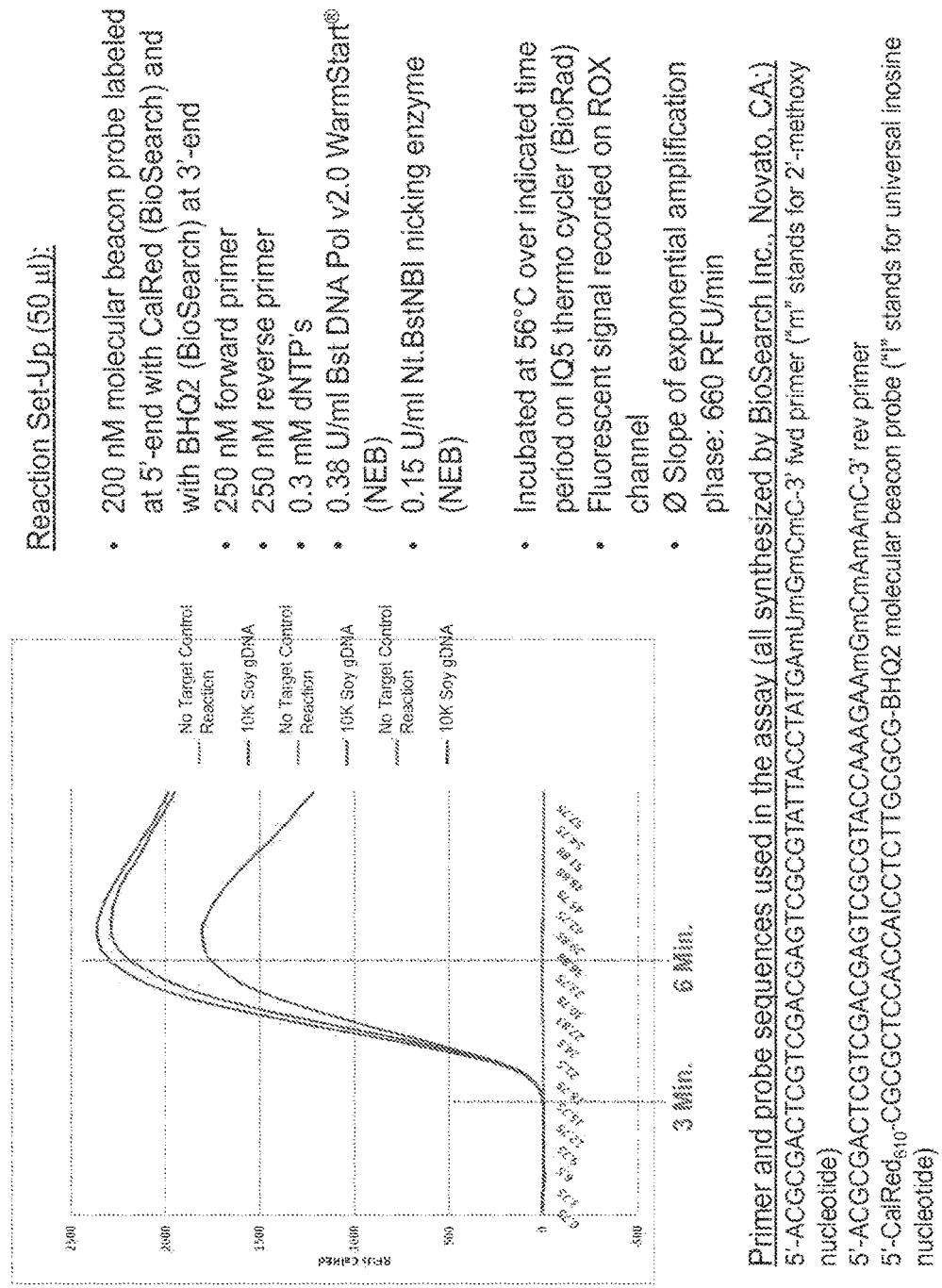

Design of an Isothermal DNA Amplification Assay for Pathogenic Salmonella enterica invA Gene From a Single Pair of Predicted Optimal Primer Structures without Screening a Multitude of Candidate Primer Combinations of Unknown Performance

- *Salmonella enterica* invA assay target sequence selected based on absence of SNP's a 30 to 60 bp sequence window:
- 5'-<u>ATACTCATCTGTTACC</u>GGGCATAC<u>CATCCAGAGAAAA</u>-3'
- Underlined are the sequence regions selected for design of the forward and reverse primers, respectively.
- Target binding region of fwd1 ans fwd2 primers: 5'-ATACTCATCTGTTTACC-3'
- $\Delta G_{25°C}$ of fwd Primer-Target Hybrid (PTH) = -26.11 kcal/mole; $\Delta G_{25°C}$ of Primer-Target binding region self dimer (PTBRHD) = -1.95 kcal/mole; $\Delta\Delta G_{25°C} = \Delta G_{PTH} - \Delta G_{PTBRHD} = -24.16$ kcal/mole
- Target binding region of Rev primer: 5'-TTTTCTCTGGATGG-3'
- $\Delta G_{25°C}$ of rev Primer-Target Hybrid (PTH) = -25.28 kcal/mole; $\Delta G_{25°C}$ of Primer-Target binding region self dimer (PTBRHD) = -1.57 kcal/mole; $\Delta\Delta G_{25°C} = \Delta G_{PTH} - \Delta G_{PTBRHD} = -23.71$ kcal/mole

Salmonella invA Assay – First Trial Experimental Results
Empirical Confirmation of Assay Performance Prediction

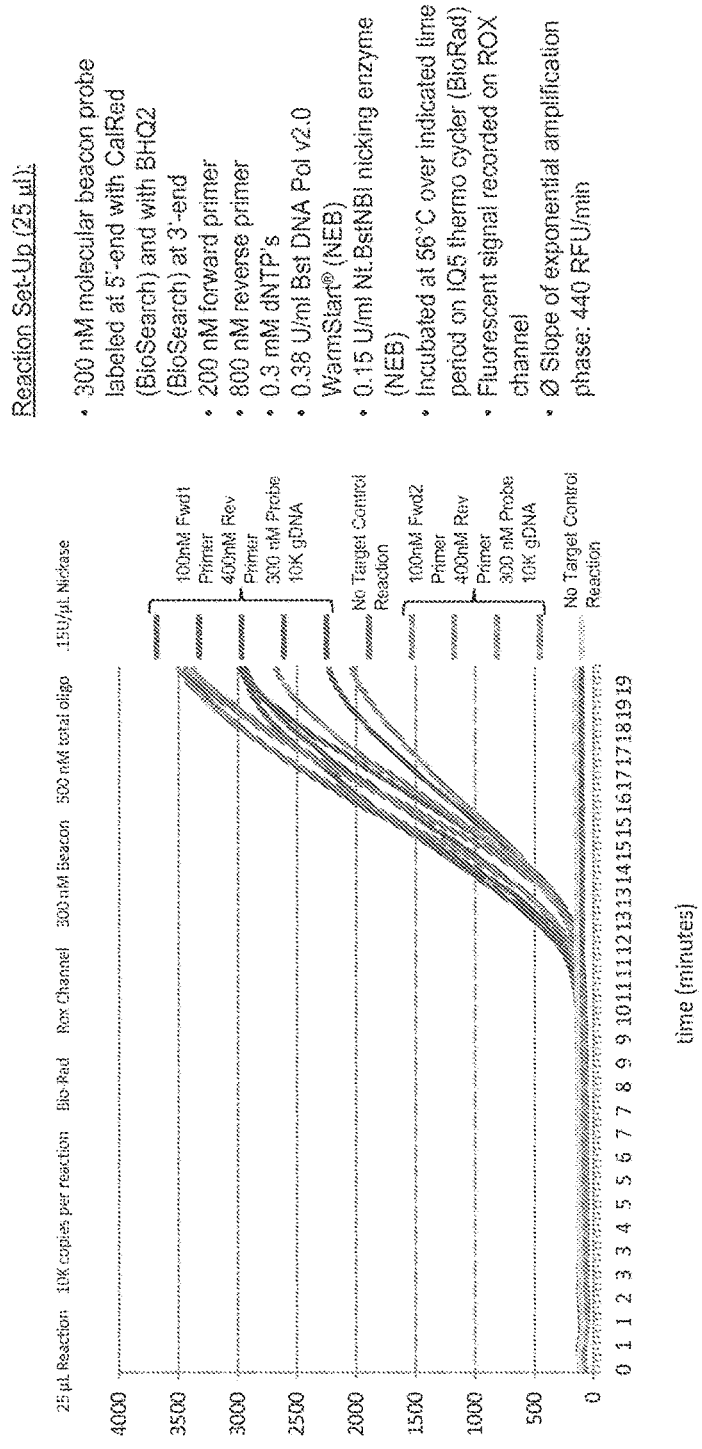

Primer and probe sequences used in the assay (all synthesized by BioSearch Inc., Novato, CA):
5'-GGCTGACTCCTGCAGGAGTCAGCAGTCAGCCATACTCAGCCATATCTGmUmUmUmAmCmC-3' fwd1 primer ("m" stands for 2'-methoxy nucleotide)
5'-GGCTGACTCCTGCAGGAGTCAGGAGTCAGCCATACTCATCTGTmUmUmUmAmCmC-3' fwd2 primer
5'-GGCTGACTCCTGCAGGAGTCAGCCTTTCTCTGmGmAmUmGmG-3' rev primer
5'-CalRed₆₁₀-ACCTGTTTACCGGGCATACAAACAGGT-BHQ2 molecular beacon probe ("I" stands for universal inosine nucleotide)

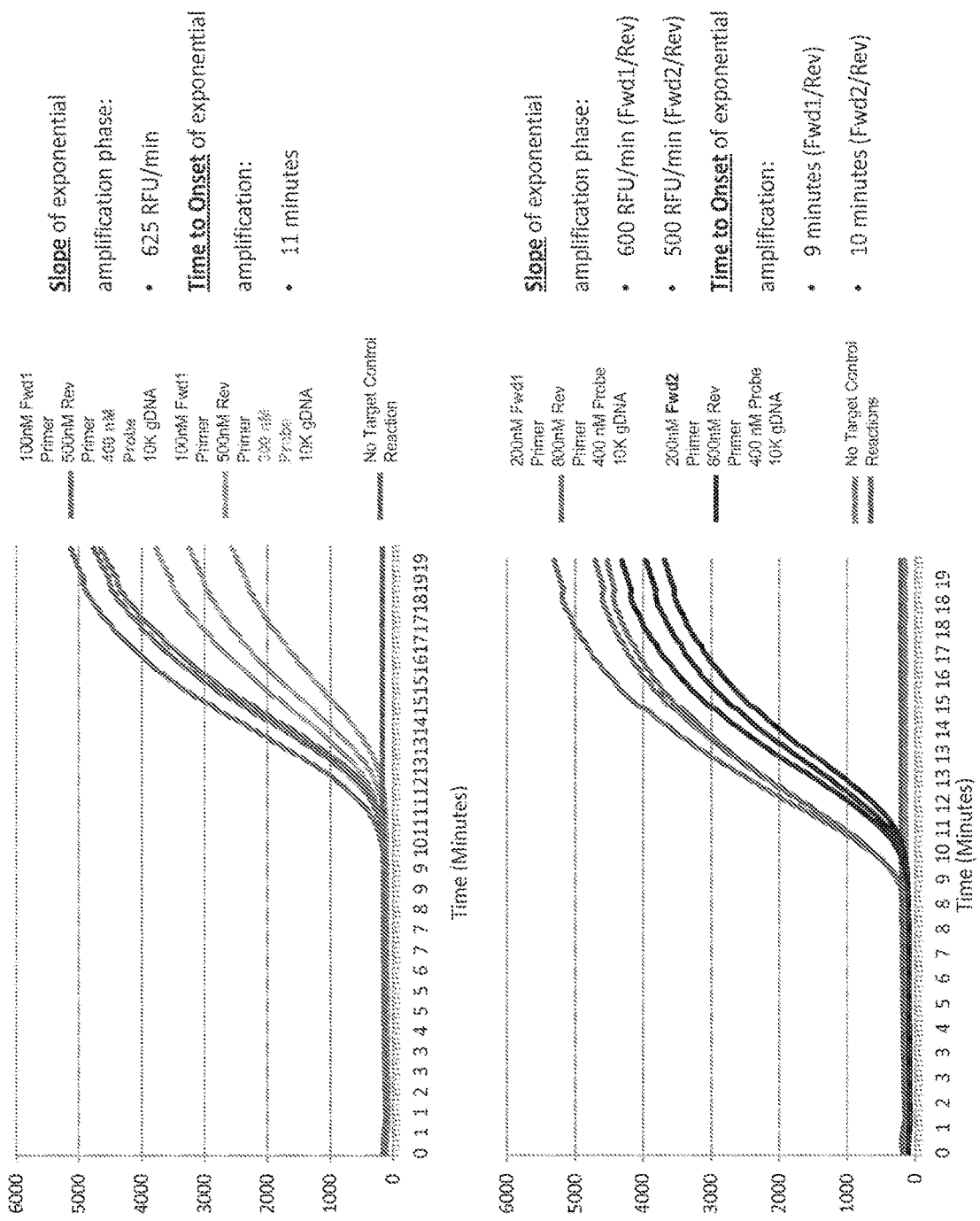

Primer Structure Parameter ($T_M$, %GC, bp Length, $\Delta G_{25°C}$, $\Delta\Delta G_{25°C}$) Cluster Analysis
To Identify Structural Parameter Predicting Function & Performance in Isothermal Amplification Primer Structure Parameter ($T_M$, %GC, bp Length, $\Delta G_{25°C}$, $\Delta\Delta G_{25°C}$) Cluster Analysis
To Identify Structural Parameter Predicting Function & Performance in Isothermal Amplification

COMPOSITIONS AND METHODS FOR ENHANCING AND/OR PREDICTING DNA AMPLIFICATION

CROSS REFERENCE TO RELATED APPLICATIONS

This application is the U.S. national phase application, pursuant to 35 U.S.C. § 371, of PCT international application Ser. No.: PCT/US2015/027074, filed Apr. 22, 2015, designating the United States and published in English, which claims priority to and the benefit of U.S. Provisional Application No. 61/982,784, filed Apr. 22, 2014, entitled "Compositions and Methods for Enhancing and/or Predicting DNA Amplification," the entire contents of which are incorporated herein by reference.

SEQUENCE LISTING

The instant application contains a Sequence Listing which has been submitted electronically in ASCII format and is hereby incorporated by reference in its entirety. Said ASCII copy, created on Feb. 8, 2019, is named 167665_010303_US_SL.txt and is 3,783,624 bytes in size.

BACKGROUND OF THE INVENTION

While methods of nucleic acid amplification are common and well-known, nucleic acid amplification reactions still suffer from unpredictable and/or poor performance due in large part to the difficulties associated with primer design. The unpredictability of nucleic acid amplification reactions is due in large part to a lack of sequence-predictable design parameters for primer and probes that allow a quantitative assessment of target-specific prime and probe hybridization versus off-target binding, self/self and self/non-self dimerization. Indeed, variability in the selection of possible primer sequences and sequence constraints imposed by target nucleic acid sequences, has made it difficult to empirically and systematically interrogate the landscape of primer combinations and their outcomes.

PCR assay-based design parameters have focused on primer and probe melting temperatures, GC (guanine and cytosine) content, primer length, and minimizing interactions of the primer with all but the target nucleic acid (see e.g., premier biosoft primer design website). In particular, use of a primer having intermolecular interactions with itself (e.g., primer-dimers) is highly discouraged, as such primers are believed to undesirably affect the interaction of the primer with the target nucleic acid molecule. Additionally, it is proposed that the optimal length of nucleic acid primers is 18-22 nucleotides, which is considered long enough for adequate specificity and short enough for primers to bind easily to the template at the annealing temperature. Regarding GC content, a GC content of 40-60% is recommended. Erroneously, common assay design practice assumes that when all the above mentioned parameters are designed equally for a forward and reverse primer of an amplification assay the hybridization kinetics of these two primers will turn out similar as well. None of these commonly used design parameters adequately correlate with complex thermodynamics of two stage oligonucleotide hybridization, which involves changes in enthalpy, entropy, solvation, nearest neighbor effects, and hydrogen bonding in the transition from the single stranded from to the double stranded hybrid stage. Moreover, even the use of the two stage model of oligonucleotide hybridization as the foundation of thermodynamic algorithms is overly simplified and does not reflect the real situation accurately. Therefore, the performance of primers meeting all of the recommended criteria remains unpredictable.

Progress in determining the effectiveness of a set of primers to predictably amplify a target nucleic acid under essentially isothermal conditions has the potential to reduce the expenditure of resources, including the effort, time, and expense of synthesizing and empirically testing a large multitude of primer sets (e.g., designing multiple primers and pairwise screening of multiple primer combinations). New parameters and methods are required to enhance and better predict the performance and yield of nucleic acid amplification reactions.

SUMMARY OF THE INVENTION

As described herein, the present invention provides improved methods for designing primers capable of predictably amplifying a target nucleic acid molecule, and methods of using these primers for nucleic acid amplification, including enhancing amplification of a target nucleic acid molecule and/or reducing or eliminating the generation of background products. Further, the invention provides compositions and methods for the amplification and detection of a sample target oligonucleotide. In particular embodiments, compositions and methods of the invention are compatible with isothermal nucleic acid amplification reactions.

In one aspect, the invention provides an isolated primer oligonucleotide containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a $\Delta G$ that is at least 15 kcal/mol lower than the $\Delta G$ of any alternate structure involving or interacting with the second region, where the second region has at the 3' end one or more 2' modified nucleotides.

In another aspect, the invention provides an isolated primer-dimer having two oligonucleotide monomers containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a $\Delta G$ that is at least 15 kcal/mol lower than the $\Delta G$ of any alternate structure involving or interacting with the second region, where the second region has at the 3' end one or more 2' modified nucleotides.

In another aspect, the invention provides an isolated oligonucleotide probe for detecting a target nucleic acid molecule containing: an oligonucleotide; a fluorescent reporter; and a quenching molecule capable of absorbing the excitation energy from the fluorescent reporter; where the fluorescent reporter and quenching molecule are covalently attached to opposite 5' and 3' ends of the oligonucleotide, where the oligonucleotide contains a first region having a nucleic acid sequence that is substantially complementary to a target nucleic acid sequence and a second region 5' upstream of the first region, and a third region 3' downstream of the first region that has a nucleic acid sequence complementary to the second region, where the oligonucleotide is capable of forming a stem-loop hairpin structure by hybridization of the second and third regions when the oligonucleotide is not bound to the target nucleic acid molecule, and where the ΔG of the double-stranded hybrid between the target sequence and the first sequence of the oligonucleotide probe is at least 15 kcal/mol lower than the ΔG of any alternate structure involving or interacting with the oligonucleotide probe.

In another aspect, the invention provides a method of amplifying a specific product in a nicking and extension amplification reaction, the method involving: contacting a target nucleic acid molecule under substantially isothermal conditions with a polymerase, two or more primers, each of which specifically binds to a complementary sequence on the target nucleic acid molecule, a nicking enzyme, and a detectable polynucleotide probe, where at least one primer contains from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; and generating amplicons containing at least a portion of the target nucleic acid molecule.

In another aspect, the invention provides a method of detecting a specific product in a nicking and extension amplification reaction, the method involving: contacting a target nucleic acid molecule under substantially isothermal conditions with a polymerase, two or more primers, each of which specifically binds to a complementary sequence on the target nucleic acid molecule, a nicking enzyme, and a detectable oligonucleotide probe, where at least one primer contains from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; generating amplicons containing at least a portion of said target nucleic acid molecule; and detecting a signal specific for oligonucleotide probe hybridization to the target nucleic acid molecule or amplicon thereof, where the signal indicates the presence of the target nucleic acid molecule present in the sample or an amplicon thereof.

In another aspect, the invention provides a kit for amplifying a target sequence in a nicking amplification reaction, the kit containing one or more primer oligonucleotides containing from 5' to 3', a first region having a self-complementary sequence containing from 5' to 3' the reverse complement of a nicking enzyme recognition sequence, a palindromic sequence, and said nicking enzyme recognition sequence, and a second region at least 16 nucleotides long that specifically binds to a complementary region on a target nucleic acid molecule to form a double-stranded hybrid having a ΔG that is at least 15 kcal/mol lower than the ΔG of any alternate structure involving or interacting with the second region, where the second region has at the 3' end one or more 2' modified nucleotides; and directions for use of the primer oligonucleotides in the methods of the invention.

In a related aspect, the invention provides a method of selecting a primer oligonucleotide according to any aspect of the invention delineated herein, including providing computer program instructions on a tangible, non-transitory computer readable medium for implementing such methods of selecting a primer oligonucleotide.

In various embodiments of the above aspects, the first region is 12, 13, 14, 15, 16, 17, 18, 19, 20, 21, 22, 23, or 24 nucleotides in length. In various embodiments, the first region is fully self-complementary. In various embodiments of the above aspects, the palindromic sequence in the first region is 2, 4, or 6 nucleotides long. In various embodiments of the above aspects, the second region is 16, 17, 18, 19, 20, 21, 22, 23, 24, 25, 26, 27, 28, 29, or 30 nucleotides in length.

In various embodiments of the above aspects, the alternate structure is one or more of a partially double-stranded hybrid that the second region can form with itself (e.g., self-self dimers), with a partial sequence of the first region (e.g., heteromdimers), with other oligonucleotides, primers, or probes in an amplification reaction, or with partially complementary nucleic acid sequences outside of the target sequence region (e.g., off-target hybrids).

In various embodiments of the above aspects, the oligonucleotide (e.g., primer oligonucleotide, oligonucleotide monomer) is in the form of a homodimer (e.g., primer-dimer) formed by hybridization of the self-complementary first region sequences of two primer oligonucleotide molecules. In various embodiments, the homodimer has a ΔG that is at least 15 kcal/mol lower than the ΔG of any alternate structure involving or interacting with the primer oligonucleotide, including the most stable alternate structure comprising the primer oligonucleotide. In various embodiments of the above aspects, the free energy (ΔG) is determined or calculated for a nucleic acid at 25° C. ($\Delta G_{25° C.}$) and/or at 1 atmosphere (atm) of pressure (~101.3 kPa). In various embodiments of the above aspects, the free energy (ΔG) is determined or calculated by the mFold algorithm.

In various embodiments of the above aspects, the second region of the oligonucleotide (e.g., primer oligonucleotide, oligonucleotide monomer) includes one or more 2' modified nucleotides, where the 2' modification is selected from the group consisting of 2'-O-methyl, 2'-methoxyethoxy, 2'-fluoro, 2'-hydroxyl, 2'-alkyl, 2'-allyl, 2'-O-[2-(methylamino)-2-oxoethyl], 4'-thio, 4'-$CH_2$—O-2'-bridge, 4'-$(CH_2)_2$—O-2'-bridge, and 2'-O—(N-methylcarbamate) or those containing base analogs. In particular embodiments, the one or more 2' modified nucleotides are positioned at the 3' terminus of the second region. In other embodiments, the two or more 2' modified nucleotides are contiguous. In still other embodiments, the number of contiguous 2' modified nucleotides is 2, 3, 4, 5, or 6. In various embodiments of any aspect delineated herein, the nicking enzyme is one or more of Nt.BspD6I andNt.BstNBI. In various embodiments of any aspect delineated herein, the nicking enzyme recognition sequence within the first region is 5'-GAGTC-3' (and the reverse complement of the nicking enzyme recognition sequence is 5'-GACTC-3'). In various embodiments of any aspect delineated herein, the oligonucleotide (e.g., primer oligonucleotide, oligonucleotide monomer) has recognition sequence of the nicking agent is positioned to cleave the phosphodiester bond between the first and second regions. In various embodiments of the above aspects, the polymerase is a *Geobacillus* spp. or *Bacillus stearothermophilus* DNA polymerase I, or active fragments and derivatives thereof. In certain embodiments, the polymerase is one or more of Bst DNA polymerase I, Gst DNA polymerase I, or Gka DNA polymerase I.

In various embodiments of any aspect delineated herein, the oligonucleotide (e.g., primer oligonucleotide, oligonucleotide monomer) has a first region including a nucleic acid sequence set forth below:

5'-GACTCN$_1$N$_{1'}$GAGTC-3'; (SEQ ID NO: 15241)

5'-GACTCN$_1$N$_{1'}$GAGTCN-3'; (SEQ ID NO: 15242)

5'-N$_2$GACTCN$_1$N$_{1'}$GAGTCN$_{2'}$-3'; (SEQ ID NO: 15243)

5'-N$_2$GACTCN$_1$N$_{1'}$GAGTCN$_2$,N-3'; (SEQ ID NO: 15244)

5'-N$_3$N$_2$GACTCN$_1$N$_{1'}$GAGTCN$_2$,N$_{3'}$-3'; (SEQ ID NO: 15245)

5'-N$_3$N$_2$GACTCN$_1$N$_{1'}$GAGTCN$_2$,N$_3$,N-3'; (SEQ ID NO: 15246)

5'-N$_4$N$_3$N$_2$GACTCN$_1$N$_{1'}$GAGTCN$_2$,N$_3$,N$_{4'}$-3'; (SEQ ID NO: 15247)

5'-N$_4$N$_3$N$_2$GACTCN$_1$N$_{1'}$GAGTCN$_2$,N$_3$,N$_4$,N-3'; (SEQ ID NO: 15248)

5'-N$_5$N$_4$N$_3$N$_2$GACTCN$_1$N$_{1'}$GAGTCN$_2$,N$_3$,N$_4$,N$_{5'}$-3'; (SEQ ID NO: 15249)

5'-GACTCN$_2$N$_1$N$_{1'}$N$_{2'}$GAGTC-3'; (SEQ ID NO: 15250)

5'-GACTCN$_2$N$_1$N$_{1'}$N$_{2'}$GAGTCN-3'; (SEQ ID NO: 15251)

5'-N$_3$GACTCN$_2$N$_1$N$_{1'}$N$_{2'}$GAGTCN$_{3'}$-3'; (SEQ ID NO: 15252)

5'-N$_3$GACTCN$_2$N$_1$N$_{1'}$N$_{2'}$GAGTCN$_3$,N-3'; (SEQ ID NO: 15253)

5'-N$_4$N$_3$GACTCN$_2$N$_1$N$_{1'}$N$_{2'}$GAGTCN$_3$,N$_{4'}$-3'; (SEQ ID NO: 15254)

5'-N$_4$N$_3$GACTCN$_2$N$_1$N$_{1'}$N$_{2'}$GAGTCN$_3$,N$_4$,N-3'; (SEQ ID NO: 15255)

5'-N$_5$N$_4$N$_3$GACTCN$_2$N$_1$N$_{1'}$N$_{2'}$GAGTCN$_3$,N$_4$,N$_{5'}$-3'; (SEQ ID NO: 15256)

5'-N$_5$N$_4$N$_3$GACTCN$_2$N$_1$N$_{1'}$N$_{2'}$GAGTCN$_3$,N$_4$,N$_5$,N-3'; and (SEQ ID NO: 15257)

5'-N$_6$N$_5$N$_4$N$_3$GACTCN$_2$N$_1$N$_{1'}$N$_{2'}$GAGTCN$_3$,N$_4$,N$_5$,N$_{6'}$-3', (SEQ ID NO: 15258)

5'-GACTCN$_3$N$_2$N$_1$N$_{1'}$,N$_{2'}$,N$_{3'}$GAGTC-3'; (SEQ ID NO: 15259)

5'-GACTCN$_3$N$_2$N$_1$N$_{1'}$,N$_{2'}$,N$_{3'}$GAGTCN-3'; (SEQ ID NO: 15260)

5'-GACTCN$_3$N$_2$N$_1$N$_{1'}$,N$_{2'}$,N$_{3'}$GAGTCNN-3'; (SEQ ID NO: 15261)

5'-GACTCN$_3$N$_2$N$_1$N$_{1'}$,N$_{2'}$,N$_{3'}$GAGTCNNN-3'; (SEQ ID NO: 15262)

5'-GACTCN$_3$N$_2$N$_1$N$_{1'}$,N$_{2'}$,N$_{3'}$GAGTCNNNN-3'; (SEQ ID NO: 15263)

5'-N$_4$GACTCN$_3$N$_2$N$_1$N$_{1'}$,N$_{2'}$,N$_{3'}$GAGTCN$_{4'}$-3'; (SEQ ID NO: 15264)

5'-N$_4$GACTCN$_3$N$_2$N$_1$N$_{1'}$,N$_{2'}$,N$_{3'}$GAGTCN$_4$,N-3'; (SEQ ID NO: 15265)

5'-N$_4$GACTCN$_3$N$_2$N$_1$N$_{1'}$,N$_{2'}$,N$_{3'}$GAGTCN$_4$,NN-3'; (SEQ ID NO: 15266)

5'-N$_4$GACTCN$_3$N$_2$N$_1$N$_{1'}$,N$_{2'}$,N$_{3'}$GAGTCN$_4$,NNN-3'; (SEQ ID NO: 15267)

5'-N$_5$N$_4$GACTCN$_3$N$_2$N$_1$N$_{1'}$,N$_{2'}$,N$_{3'}$GAGTCN$_4$,N$_{5'}$-3'; (SEQ ID NO: 15268)

5'-N$_5$N$_4$GACTCN$_3$N$_2$N$_1$N$_{1'}$,N$_{2'}$,N$_{3'}$GAGTCN$_4$,N$_5$,N-3'; (SEQ ID NO: 15269)

5'-N$_6$N$_5$N$_4$GACTCN$_3$N$_2$N$_1$N$_{1'}$,N$_{2'}$,N$_{3'}$GAGTCN$_4$,N$_5$,N$_{6'}$-3'; (SEQ ID NO: 15270)

5'-N$_6$N$_5$N$_4$GACTCN$_3$N$_2$N$_1$N$_{1'}$,N$_{2'}$,N$_{3'}$GAGTCN$_4$,N$_5$,N$_6$,N-3'; and (SEQ ID NO: 15271)

5'-N$_7$N$_6$N$_5$N$_4$GACTCN$_3$N$_2$N$_1$N$_{1'}$,N$_{2'}$,N$_{3'}$GAGTCN$_4$,N$_5$,N$_6$,N$_{7'}$-3', (SEQ ID NO: 15272)

where "N" is any nucleotide (e.g., having an adenine (A), thymine (T), cytosine (C), or guanine (G) nucleobase), and $N_1$ is complementary to $N_{1'}$, $N_2$ to $N_{2'}$, $N_3$ to $N_{3'}$, $N_4$ to $N_{4'}$, $N_5$ to $N_{5'}$, $N_6$ to $N_{6'}$, and $N_7$ to $N_{7'}$. In certain embodiments, the oligonucleotide (e.g., primer oligonucleotide, oligonucleotide monomer) comprises a 5' tail region comprising a sequence set forth in the Sequence Listing submitted herewith.

In various embodiments of any aspect delineated herein, the oligonucleotide probe for detecting a target nucleic acid molecule contains: an oligonucleotide; a fluorescent reporter; and a quenching molecule capable of absorbing the excitation energy from the fluorescent reporter; where the fluorescent reporter and quenching molecule are covalently attached to opposite 5' and 3' ends of the oligonucleotide, where the oligonucleotide contains a first region having a nucleic acid sequence that is substantially complementary to a target nucleic acid sequence and a second region 5' upstream of the first region, and a third region 3' downstream of the first region that has a nucleic acid sequence complementary to the second region, where the oligonucleotide is capable of forming a stem-loop hairpin structure by hybridization of the second and third regions when the oligonucleotide is not bound to the target nucleic acid molecule. In various embodiments of any aspect delineated herein, the ΔG of the double-stranded hybrid between the target sequence and the first sequence of the oligonucleotide probe is at least 15 kcal/mol lower than the ΔG of any alternate structure involving or interacting with the oligonucleotide probe. In various aspects, the second and the third regions of the oligonucleotide probe are 4-8 nucleotides in length.

In various embodiments of any aspect delineated herein, directions are provided for use of the primer oligonucleotides and/or oligonucleotide probes of the invention. In various embodiments of any aspect delineated herein, the primers and probes in a reaction are designed and/or selected to perform together in an amplification and detection reaction.

Other features and advantages of the invention will be apparent from the detailed description, and from the claims.

Definitions

By "amplicon" is meant a polynucleotide generated during the amplification of a polynucleotide of interest. In one example, an amplicon is generated during a polymerase chain reaction.

By "amplification rate modifiers" is meant an agent capable of affecting the rate of polymerase extension.

By "base substitution" is meant a substituent of a nucleobase polymer that does not cause significant disruption of the hybridization between complementary nucleotide strands.

In this disclosure, "comprises," "comprising," "containing" and "having" and the like can have the meaning ascribed to them in U.S. Patent law and can mean "includes," "including," and the like; "consisting essentially of" or "consists essentially" likewise has the meaning ascribed in U.S. Patent law and the term is open-ended, allowing for the presence of more than that which is recited so long as basic or novel characteristics of that which is recited is not changed by the presence of more than that which is recited, but excludes prior art embodiments.

By "complementary" or "complementarity" is meant that a nucleic acid can form hydrogen bond(s) with another nucleic acid sequence by either traditional Watson-Crick or Hoogsteen base pairing. Complementary base pairing includes not only G-C and A-T base pairing, but also includes base pairing involving universal bases, such as inosine. A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). To determine that a percent complementarity is of at least a certain percentage, the percentage of contiguous residues in a nucleic acid molecule that can form hydrogen bonds (e.g., Watson-Crick base pairing) with a second nucleic acid sequence is calculated and rounded to the nearest whole number (e.g., 12, 13, 14, 15, 16, or 17 nucleotides out of a total of 23 nucleotides in the first oligonucleotide being based paired to a second nucleic acid sequence having 23 nucleotides represents 52%, 57%, 61%, 65%, 70%, and 74%, respectively; and has at least 50%, 50%, 60%, 60%, 70%, and 70% complementarity, respectively). As used herein, "substantially complementary" refers to complementarity between the strands such that they are capable of hybridizing under biological conditions. Substantially complementary sequences have 60%, 70%, 80%, 90%, 95%, or even 100% complementarity. Additionally, techniques to determine if two strands are capable of hybridizing under biological conditions by examining their nucleotide sequences are well known in the art.

As used herein, "duplex" refers to a double helical structure formed by the interaction of two single stranded nucleic acids. A duplex is typically formed by the pairwise hydrogen bonding of bases, i.e., "base pairing", between two single stranded nucleic acids which are oriented antiparallel with respect to each other. Base pairing in duplexes generally occurs by Watson-Crick base pairing, e.g., guanine (G) forms a base pair with cytosine (C) in DNA and RNA, adenine (A) forms a base pair with thymine (T) in DNA, and adenine (A) forms a base pair with uracil (U) in RNA. Conditions under which base pairs can form include physiological or biologically relevant conditions (e.g., intracellular: pH 7.2, 140 mM potassium ion; extracellular pH 7.4, 145 mM sodium ion). Furthermore, duplexes are stabilized by stacking interactions between adjacent nucleotides. As used herein, a duplex may be established or maintained by base pairing or by stacking interactions. A duplex is formed by two complementary nucleic acid strands, which may be substantially complementary or fully complementary. Single-stranded nucleic acids that base pair over a number of bases are said to "hybridize."

"Detect" refers to identifying the presence, absence or amount of the analyte to be detected.

By "detectable moiety" is meant a composition that when linked to a molecule of interest renders the latter detectable, via spectroscopic, photochemical, biochemical, immunochemical, or chemical means. For example, useful labels include radioactive isotopes, magnetic beads, metallic beads, colloidal particles, fluorescent dyes, electron-dense reagents, enzymes (for example, as commonly used in an ELISA), biotin, digoxigenin, or haptens.

By "fragment" is meant a portion of a nucleic acid molecule. This portion contains, preferably, at least 10%, 20%, 30%, 40%, 50%, 60%, 70%, 80%, or 90% of the entire length of the reference nucleic acid molecule or polypeptide. A fragment may contain 5, 10, 15, 20, 30, 40, 50, 60, 70, 80, 90, or 100 nucleotides.

By "free energy ($\Delta G$)" is meant the net exchange of energy between the system and its environment at a constant temperature and pressure described by the formula: $\Delta G = \Delta H - T\Delta S$. Free energy represents how favorable the formation of a structure is, where the formation of a structure having a more negative $\Delta G$ (e.g., expressed in kcal/mol) is thermodynamically more favored in a dynamic equilibrium of multiple alternate structures. Accordingly, $\Delta \Delta G$ measures the difference in favorability between the formation of two different structures having two different $\Delta G$s. In one aspect, $\Delta \Delta G$ provides a numerical score measuring the favorability of formation of a desired oligonucleotide structure over the possible formation of other undesirable structures in dynamic equilibrium. In one embodiment, the first structure is the duplex hybrid formed between the first region (5' tail region) of one oligonucleotide and the first region (5' tail region) of a second oligonucleotide having the same nucleic acid sequence as the first oligonucleotide; and the second structure is any other alternate structure comprising the oligonucleotide.

By "hybridize" is meant to form a double-stranded molecule between complementary polynucleotide sequences (e.g., a gene described herein), or portions thereof, under various conditions of stringency. (See, e.g., Wahl, G. M. and S. L. Berger (1987) Methods Enzymol. 152:399; Kimmel, A. R. (1987) Methods Enzymol. 152:507). Hybridization occurs by hydrogen bonding, which may be Watson-Crick, Hoogsteen or reversed Hoogsteen hydrogen bonding, between complementary nucleobases. For example, adenine and thymine are complementary nucleobases that pair through the formation of hydrogen bonds.

By "nucleic acid hybrid" is meant a substantially double-stranded molecule formed by the binding of complementary nucleic acid molecules. In one embodiment, the double-stranded molecule is partially or fully double-stranded.

By "isolated polynucleotide" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule that is transcribed from a DNA molecule, as well as a recombinant DNA that is part of a hybrid gene encoding additional polypeptide sequence.

The terms "isolated," "purified," or "biologically pure" refer to material that is free to varying degrees from components which normally accompany it as found in its native state. "Isolate" denotes a degree of separation from original source or surroundings. "Purify" denotes a degree of separation that is higher than isolation. A "purified" or "biologically pure" protein is sufficiently free of other materials such that any impurities do not materially affect the biological properties of the protein or cause other adverse consequences. That is, a nucleic acid or peptide of this invention is purified if it is substantially free of cellular material, viral material, or culture medium when produced by recombinant DNA techniques, or chemical precursors or other chemicals when chemically synthesized. Purity and homogeneity are typically determined using analytical chemistry techniques, for example, polyacrylamide gel electrophoresis or high performance liquid chromatography. The term "purified" can denote that a nucleic acid or protein gives rise to essentially one band in an electrophoretic gel. For a protein that can be subjected to modifications, for example, phosphorylation or glycosylation, different modifications may give rise to different isolated proteins, which can be separately purified.

By "melting temperature (Tm)" is meant the temperature of a system in equilibrium where 50% of the molecular population is in one state and 50% of the population is in another state. With regard to the nucleic acids of the invention, Tm is the temperature at which 50% of the population is single-stranded and 50% is double-stranded (e.g., intramolecularly or intermolecularly).

By "monitoring a reaction" is meant detecting the progress of a reaction. In one embodiment, monitoring reaction progression involves detecting polymerase extension and/or detecting the completion of an amplification reaction.

As used herein, "obtaining" as in "obtaining an agent" includes synthesizing, purchasing, or otherwise acquiring the agent.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, 2' modified nucleotides (e.g., 2'-O-methyl ribonucleotides, 2'-F nucleotides).

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-O-methyl, 2'-methoxyethoxy, 2'-fluoro, 2'-hydroxyl (RNA), 2'-allyl, 2'-O-[2-(methylamino)-2-oxoethyl], 4'-thio, 4'-CH$_2$—O-2'-bridge, 4'-(CH$_2$)$_2$—O-2'-bridge, and 2'-O—(N- methylcarbamate) or those comprising base analogs.

By "nucleotide adduct" is meant a moiety that is bound covalently or otherwise fixed to a standard nucleotide base.

By "nicking agent" is meant a chemical entity capable of recognizing and binding to a specific structure in double stranded nucleic acid molecules and breaking a phosphodiester bond between adjoining nucleotides on a single strand upon binding to its recognized specific structure, thereby creating a free 3'-hydroxyl group on the terminal nucleotide preceding the nick site. In preferred embodiments, the 3' end can be extended by an exonuclease deficient polymerase. Exemplary nicking agents include nicking enzymes, RNAzymes, DNAzymes, and transition metal chelators.

By "palindromic" is meant nucleic acid sequences that are identical when read from 5' to 3' on one strand or 5' to 3' on the complementary strand. A perfect palindrome refers to a sequence having two adjacent subsequences, such that when one subsequence is read from the 5' to 3' direction, it is identical to the other subsequence read from the 3' to 5' direction.

By "polymerase-arresting molecule" is meant a moiety associated with a polynucleotide template or primer that prevents or significantly reduces the progression of a polymerase on the polynucleotide template. Preferably, the moiety is incorporated into the polynucleotide. In one preferred embodiment, the moiety prevents the polymerase from progressing on the template.

By "polymerase extension" is meant the forward progression of a polymerase that matches incoming monomers to their binding partners on a template polynucleotide.

As used herein, "primer-dimer" is meant a dimer of two monomer oligonucleotide primers. In the oligonucleotide primers of the invention, the 5' tail regions of monomer primers dimerize.

By "specific product" is meant a polynucleotide product resulting from the hybridization of primer oligonucleotides to a complementary target sequence and subsequent polymerase mediated extension of the target sequence.

By "substantially isothermal condition" is meant at a single temperature or within a narrow range of temperatures that does not vary significantly. In one embodiment, a reaction carried out under substantially isothermal conditions is carried out at a temperature that varies by only about 1-5° C. (e.g., varying by 1, 2, 3, 4, or 5 degrees). In another embodiment, the reaction is carried out at a single temperature within the operating parameters of the instrument utilized.

By "reference" is meant a standard or control condition. As is apparent to one skilled in the art, an appropriate reference is where an element is changed in order to determine the effect of the element.

By "subject" is meant a mammal, including, but not limited to, a human or non-human mammal, such as a bovine, equine, canine, ovine, or feline.

By "target nucleic acid molecule" is meant a polynucleotide to be analyzed. Such polynucleotide may be a sense or antisense strand of the target sequence. The term "target nucleic acid molecule" also refers to amplicons of the original target sequence.

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Unless specifically stated or obvious from context, as used herein, the term "or" is understood to be inclusive. Unless specifically stated or obvious from context, as used herein, the terms "a", "an", and "the" are understood to be singular or plural.

Unless specifically stated or obvious from context, as used herein, the term "about" is understood as within a range of normal tolerance in the art, for example within 2 standard deviations of the mean. About can be understood as within 10%, 9%, 8%, 7%, 6%, 5%, 4%, 3%, 2%, 1%, 0.5%, 0.1%, 0.05%, or 0.01% of the stated value. Unless otherwise clear from context, all numerical values provided herein are modified by the term about.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Any compositions or methods provided herein can be combined with one or more of any of the other compositions and methods provided herein.

BRIEF DESCRIPTION OF THE DRAWINGS

FIG. 1 depicts a mechanism describing a strand displacement nucleic acid amplification reaction of a target nucleic acid molecule having efficient, exponential amplification. The interaction of the 3' end of a target nucleic acid molecule (gray) with a corresponding, sequence-specific primer having a 3' recognition region (red) and "5' tail" region capable of dimerization (black) is shown. For target specific amplification, the 3' recognition region (red) is complementary in sequence to and capable of specifically hybridizing to the target nucleic acid. The primer in an active configuration is a stable homodimer (termed a "primer-dimer") formed by the dimerization of the 5' tail regions of two monomer primers. In one specific embodiment, the primer has a self-complementary, symmetrically inverted sequence. The resulting primer-dimer has a double-stranded or substantially double-stranded dimerization region (black) that is 5' with respect to the single-stranded recognition regions (red). That is, the target specific portion of the primer (capable of annealing to the target nucleic acid molecule) is exposed in the primer-dimer as the 3' single-stranded regions. At the start of the reaction, a 3' single-strand portion of the primer-dimer anneals to a target nucleic acid molecule, and initiates replication of the target nucleic acid molecule. During the course of the reaction, monomer primers are released from extended primer-dimers by polymerase strand displacement action from synthesis of the complementary strand. To enhance the specificity and/or efficiency of the amplification reaction, monomer primers are designed to have (1) a 5' tail region having a sequence that is self-complementary, symmetrical or substantially symmetrical, and capable of base pairing to itself and (2) a 3' recognition region perfectly or substantially complementary in sequence to and capable of specifically hybridizing to the target nucleic acid molecule. When ΔG for primer-dimer formation is low, the time a primer is present as a monomer with an open configuration is minimized. Monomer primers are undesirable because they can serve as either a template or primer in non-target-specific primer extension reactions, thereby generating and/or amplifying background. Preferably, the transition from monomer to dimer is "virtually instantaneous" or as brief as kinetically possible. Thermodynamic factors (e.g., very low ΔG of primer-dimer formation, high primer concentration, high dimer Tm) are used to favor primer-dimer formation.

FIG. 2 depicts a mechanism describing a strand displacement nucleic acid amplification reaction of a target nucleic acid having inefficient amplification. The interaction of the 3' end of a target nucleic acid molecule (gray) with a corresponding, sequence-specific primer (red and black) is shown. Isothermal reactions where monomer primers in an open configuration persist throughout the reaction lead to linear non-specific background amplification. Primer monomers that do not favor primer-dimer formation have, for example, minimal or no self-complementary sequences in the 5' portion of the monomer primer (black), resulting in a high ΔG for primer-dimer formation. Because interaction of the primer-dimer with the target nucleic acid molecule drives the annealing and extension reactions, formation of primer-dimers affects the efficiency of target nucleic acid synthesis and/or amplification. In the fully or partially open configuration, a primer monomer can serve either as a template or a primer in non-target-specific primer extension reactions (see inset), which leads to additional reaction inefficiencies. Where the open configuration of monomer primers is not minimized (e.g., by sequence design), the transition from monomer to dimer is slow, because it is not favored by thermodynamic factors (e.g., multiple dimer and partial dimer configurations co-having similar ΔG's and low dimer Tm's).

FIG. 3 depicts primer structures that inhibit primer-dimer formation including, for example, structures (A) to (C) which lead to amplification of non-specific by-products (structures (H) to (J)) or structures (D) and (K), which are incapable of target hybridization. Interactions between primers (red and black) nucleic acid fragments (gray) are shown. Structure (A) depicts a primer monomer having a discontinuous inverted sequence in the target specific region that is capable of "looping" back to create an extendable 3'-end for "self-replication." Structure (A) also has a 5' region that loops back on itself to form a hairpin structure. Structure (B) depicts a primer-dimer having discontinuous inverted sequences in the target specific region of the primer that are capable of "looping" back to create extendable 3'-ends for "self-replication. Structure (C) depicts a false hybrid structure between a primer monomer in "open" configuration and a single stranded DNA fragment (gray) displaced by DNA polymerase nick-extension reactions from closely positioned random and/or sequence-specific nicks in template DNA. Structure (D) depicts a partially double-stranded dimer structure, where a significant part of the target-specific region is not accessible for target hybridization. Structure (D) may be formed by inverted sequence repeats in the primer monomer. Structure (E) depicts an intermediate, false primer extension/strand displacement reaction product generated from structure (A). Structure (G) depicts an intermediate, false primer extension/strand displacement reaction product generated from structure (B). Structure (H) depicts a mature, false reaction product in "nick & kick" mode, resulting in continuous recycling and amplification of single stranded by-products. Structure (J) depicts mature, false reaction products in "nick & kick" mode, resulting in continuous recycling and amplification of single stranded by-products. Structure (K) depicts the persistence of the partially double-stranded dimer of structure (D) in the reaction. Because a significant part of the target-specific region is not accessible for target hybridization, target nucleic acid replication and/or amplification is inhibited or fails to initiate. Primer design in accordance with the invention promotes optimal primer-dimer formation, which minimizes the formation of undesirable primer structures and their inhibitory effects on target specific nucleic acid amplification.

FIG. 7 depicts a homodimer of a primer dimer having a 5' tail region with a nicking enzyme recognition sequence for a top strand nicking enzyme (Nt.BstNBI). The nick site is designed to be positioned between the nucleotide at the 3' end of the 5' tail region and the nucleotide at the 5' end of the 3' recognition region. Without being bound to theory, the nicking enzyme does not cleave at the nick site when the 3' recognition is single-stranded. However, cleavage at the nick site occurs when the 3' recognition region is double stranded (e.g., when the primer is incorporated into a double-stranded target nucleic acid molecule during the course of the nucleic acid amplification reaction). FIG. 7 discloses SEQ ID NOS 15515 and 15515, respectively, in order of appearance.

FIGS. 8A-8B depict exemplary 5' tail region sequences. FIG. 8A depicts exemplary 5' tail region sequences 24 nucleotides in length having a Nt.BstNBI recognition sequence and based on the following formula: 5'-NNNNGACTCNNNNNNNGAGTCNNNN-3' (SEQ ID NO: 15272). Based on this formula, there are 537,824 5' tail sequences having the following properties: ΔG=−34.2 Kcal/mole to −65 kcal/mole; ΔΔG<−40 kcal/mole; and GC content 68% to 84%. Of these, 1100 selected sequences are provided, representing 0.2% of the entire sequence space (248,832). FIG. 8A discloses the sequences in the first column as SEQ ID NOS 582, 591, 599, 603, 606, 602, 594, 593, 597, 592, 596, 595, 598, 584, 588, 583, 587, 585, 589, 586, 590, 621, 623, 609, 613, 622, 624, 607, 611, 608, 612, 15329, 15330, 176, 15331, 185, 15332, 193, 197, 200, 196, 15333, 188, 15334, 187, 191, 186, 190, 189, 192, 178, 182, 15335, 15336, 177, 181, 179, 183, 180, 184, 215, 217, 203, 207, 216, 218, 201, 205, 202, 206, 15337, 15338, 15339, 15340, 15341, 15342, 15343, 15344, 15345, 15346, 15347, 15348, 15349, 15350, 15351, 15352, 15353, 15354, 15355, 15356, 15357, 15358, 15359, 15360, 15361, 15362, 15363, 15364, 15365, 15366, 15367, 1046, 1055, 1063, 1067, 1070, 1066, 1058, 1057, 1061, 1056, 1060, 1059, 1062, 1048, 1052, 1047, 1051, 1049, 1053, 1050, 1054, 1085, 1087, 1073, 1077, 1086, 1088, 1071, 1075, 1072, 1076, 15368, 15369, 15370, 15371, 15372, 15373, 15374, 15375, 15376, 15377, 15378, 15379, 15380, 15381, 15382, 15383, 15384, 15385, 15386, 15387, 15388, 15389, 15390, 15391, 15392, 15393, 15394, 15395, 15396, 15397, 15398, 640, 649, 657, 661, 664, 660, 652, 651, 655, 650, 654, 653, 656, 642, 646, 641, 645, 643, 647, 644, 648, 679, 681, 667, 671, 680, 682, 665, 669, 666, 670, 814, 823, 831, 835, 838, 834, 826, 825, 829, 824, 828, 827, 830, 816, 820, 815, 819, 817, 821, 818, 822, 853, 855, 841, 845, 854, 856, 839, 843, 840, 844, 15407, 15408, 2264, 15409, 2273, 15410, 2281, 2285, 2288, 2284, 15411, 2276, 15412, 2275, 2279, 2274, 2278, 2277, 2280, 2266, 2270, 15413, 15414, 2265, 2269, 2267, 2271, 2268, 2272, 2303, 2305, 2291, 2295, 2304, 2306, 2289, 2293, 2290, 2294, 2206, 2215, 2223, 2227, 2230, 2226, 2218, 2217, 2221, 2216, 2220, 2219, 2222, 2208, 2212, 2207, 2211, 2209, 2213, 2210, 2214, 2245, 2247, 2233, 2237, 2246, 2248, 2231, 2235, 2232, 2236, 814, 823, 831, 835, 838, 834, 826, 825, 829, 824, 828, 827, 830, 816, 820, 815, 819, 817, 821, 818, 822, 853, 855, 841, 845, 854, 856, 839, 843, 840, 844, 2264, 2273, 2281, 2285, 2288, 2284, 2276, 2275, 2279, 2274, 2278, 2277, 2280, 2266, 2270, 2265, 2269, 2267, 2271, 2268, 2272, 2303, 2305, 2291, 2295, 2304, 2306, 2289, 2293, 2290, 2294, 872, 881, 889, 893, 896, 892, 884, 883, 887, 882, 886, 885, 888, 874, 878, 873, 877, 875, 879, 876, 880, 911, 913, 899, 15415, 912, 914, 897, 901, 898, 902, 524, 533, 541, 545, 548, 544, 536, 535, 539, 534, 538, 537, 540, 526, 530, 525, 529, 527, 531, 528, 532, 563, 565, 551, 555, 564, 566, 549, 553, 550, 554, 15454, 15455, 1800, 15456, 1809, 15457, 1817, 1821, 1824, 1820, 15458, 1812, 15459, 1811, 1815, 1810, 1814, 1813, 1816, 1802, 1806, 15460, 15461, 1801, 1805, 1803, 1807, 1804, 1808, 1839, 1841, 1827, 1831, 1840, 1842, 1825, 1829, 1826, 1830, 930, 939, 947, 951, 954, 950, 942, 941, 945, 940, 944, 943, 946, 932, 936, 931, 935, 933, 937, 934, 938, 969, 971, 957, 961, 970, 972, 955, 959, 956, 960, 15462, 15462, 15463, 15464, 15465, 15466, 15467, 15468, 15469, 15470, 15471, 15472, 15473, 15474, 15475, 15476, 15477, 15478, 15479, 15480, 15481, 15482, 15483, 15484, 15485, 15486, 15487, 15488, 15489, 15490, 15491, 524, 533, 541, 545, 548, 544, 536, 535, 539, 534, 538, 537, 540, 526, 530, 525, 529, 527, 531, 528, 532, 563, 565, 551, 555, 564, 566, 549, 553, 550, 554, 1767, 1771, 1768 and 1772, and the sequences in the second column as SEQ ID NOS 1974, 1983, 1991, 1995, 1998, 1994, 1986, 1985, 1989, 1984, 1988, 1987, 1990, 1976, 1980, 1975, 1979, 1977, 1981, 1978, 1982, 2013, 2015, 2001, 2005, 2014, 2016, 1999, 2003, 2000, 2004, 15399, 15400, 408, 15401, 417, 15402, 425, 429, 432, 428, 15403, 420, 15404, 419, 423, 418, 422, 421, 424, 410, 414, 15405, 15406, 409, 413, 411, 415, 412, 416, 447, 449, 435, 439, 448, 450, 433, 437, 434, 438, 350, 359, 367, 371, 374, 370, 362, 361, 365, 360, 364, 363, 366, 352, 356, 351, 355, 353, 357, 354, 358, 389, 391, 377, 381, 390, 392, 375, 379, 376, 380, 1974, 1983, 1991, 1995, 1998, 1994, 1986, 1985, 1989, 1984, 1988, 1987, 1990, 1976, 1980, 1975, 1979, 1977, 1981, 1978, 1982, 2013, 2015, 2001, 2005, 2014, 2016, 1999, 2003, 2000, 2004, 408, 417, 425, 429, 432, 428, 420, 419, 423, 418, 422, 421, 424, 410, 414, 409, 413, 411, 415, 412, 416, 447, 449, 435, 439, 448, 450, 433, 437, 434, 438, 2032, 2041, 2049, 2053, 2056, 2052, 2044, 2043, 2047, 2042, 2046, 2045, 2048, 2034, 2038, 2033, 2037, 2035, 2039, 2036, 2040, 2071, 2073, 2059, 2063, 2072, 2074, 2057, 2061, 2058, 2062, 1278, 1287, 1295, 1299, 1302, 1298, 1290, 1289, 1293, 1288, 1292, 1291, 1294, 1280, 1284, 1279, 1283, 1281, 1285, 1282, 1286, 1317, 1319, 1305, 1309, 1318, 1320, 1303, 1307, 1304, 1308, 15416, 15417, 1568, 15418, 1577, 15419, 1585, 1589, 1592, 1588, 15420, 1580, 15421, 1579, 1583, 1578, 1582, 1581, 1584, 1570, 1574, 15422, 15423, 1569, 1573, 1571, 1575, 1572, 1576, 1607, 1609, 1595, 1599, 1608, 1610, 1593, 1597, 1594, 1598, 15424, 15424, 15425, 15426, 15427, 15428, 15429, 15430, 15431, 15432, 15433, 15434, 15435, 15436, 15437, 15438, 15439, 15440, 15441, 15442, 15443, 15444, 15445, 15446, 15447, 15448, 15449, 15450, 15451, 15452, 15453, 1510, 1519, 1527, 1531, 1534, 1530, 1522, 1521, 1525, 1520, 1524, 1523, 1526, 1512, 1516, 1511, 1515, 1513, 1517, 1514, 1518, 1549, 1551, 1537, 1541, 1550, 1552, 1535, 1539, 1536, 1540, 1336, 1345, 1353, 1357, 1360, 1356, 1348, 1347, 1351, 1346, 1350, 1349, 1352, 1338, 1342, 1337, 1341, 1339, 1343, 1340, 1344, 1375, 1377, 1363, 1367, 1376, 1378, 1361, 1365, 1362, 1366, 1336, 1345, 1353, 1357, 1360, 1356, 1348, 1347, 1351, 1346, 1350, 1349, 1352, 1338, 1342, 1337, 1341, 1339, 1343, 1340, 1344, 1375, 1377, 1363, 1367, 1376, 1378, 1361, 1365, 1362, 1366, 466, 475, 483, 487, 490, 486, 478, 477, 481, 476, 480, 479, 482, 468, 472, 467, 471, 469, 473, 470, 474, 505, 507, 493, 497, 506, 508, 491, 495, 492, 496, 15492, 15493, 60, 15494, 69, 15495, 77, 81, 84, 80, 15496, 72, 15497, 71, 75, 70, 74, 73, 76, 62, 66, 15498, 15499, 61, 65, 63, 67, 64, 68, 99, 101, 87, 91, 100, 102, 85, 89, 86, 90, 15500, 15501, 2, 15502, 11, 15503, 19, 23, 26, 22, 15504, 14, 15505, 13, 17, 12, 16, 15, 18, 4, 8, 15506, 15507, 3, 7, 5, 9, 6, 10, 41, 43, 29, 33, 42, 44, 27, 31, 28, 32, 466, 475, 483, 487, 490, 486, 478, 477, 481, 476, 480, 479, 482, 468, 472, 467, 471, 469, 473, 470, 474, 505, 507, 493, 497, 506, 508, 491, 495, 492, 496, 1742, 1751, 1759, 1763, 1766, 1762, 1754, 1753, 1757, 1752, 1756, 1755, 1758, 1744, 1748, 1743, 1747, 1745, 1749, 1746, 1750, 1781, 1783, 1769, 1773, 1782 and 1784, all respectively, in order of appearance. FIG. 8B depicts exemplary 5' tail region sequences 22 nucleotides in length having a Nt.BstNBI recognition sequence and based on the following formula: 5'-NNNNGACTCNNNN-GAGTCNNNN-3' (SEQ ID NO: 15258). Based on this formula, there are 248,832 5' tail sequences having the following properties: $\Delta G=-47$ Kcal/mole to $-55$ kcal/mole; $\Delta\Delta G<-40$ kcal/mole; and GC content 72% to 82%. Of these, 200 selected sequences are provided, representing 0.08% of the entire sequence space (248,832). FIG. 8B discloses the sequences in the first column as SEQ ID NOS 10411, 10420, 10428, 15516, 15517, 15518, 15519, 10548, 10435, 10431, 10423, 10422, 10426, 10421, 10425, 10424, 10427, 10413, 10417, 10412, 10416, 10414, 10418, 10415, 10419, 10450, 10452, 10438, 10442, 10451, 10453, 10436, 10440, 10437, 10441, 15520, 10551, 10547, 10539, 10538, 10542, 10537, 10541, 10540, 10543, 10529, 10533, 15541, 10528, 10532, 10530, 10534, 10531, 10535, 10566, 10568, 10554, 10558, 10567, 10569, 10552, 10556, 10553, 10557, 15542, 15543, 10933, 15544, 10942, 15545, 10950, 15546, 10659, 10645, 10649, 10644, 10648, 10646, 10650, 10647, 10651, 10682, 10684, 10670, 10674, 10683, 10685, 10668, 10672, 10669, 10673, 15565, 10701, 10710, 10718, 15566, 15567, 15568, 15569, 10722, 10725, 10721, 10713, 10712, 10716, 10711, 10715 and 10714, and the sequences in the second column as SEQ ID NOS 10469, 10478, 10486, 15521, 15522, 15523, 15524, 10991, 11000, 11008, 15525, 15526, 15527, 15528, 10817, 10826, 10834, 15529, 15530, 15531, 15532, 10875, 10884, 10892, 15533, 15534, 15535, 15536, 15537, 15538, 10527, 15539, 10536, 15540, 10544, 10548, 15547, 10585, 15548, 10594, 15549, 10602, 15550, 15551, 10759, 15552, 10768, 15553, 10776, 15554, 15555, 15556, 15557, 15558, 15559, 15560, 10643, 10652, 10660, 15561, 15562, 15563, 15564, 10664, 10667, 10663, 10655, 10654, 10658, 10653, 10657, 10656, 10717, 10703, 10707, 10702, 10706, 10704, 10708, 10705, 10709, 10740, 10742, 10728, 10732, 10741, 10743, 10726, 10730, 10727, 10731 and 15570, all respectively, in order of appearance.

FIG. 12 depicts the design of an isothermal DNA amplification assay for Soy Lectin from a single pair of predicted optimal primer structures and a single predicted optimal probe without screening a multitude of candidate primer combinations of unknown performance. FIG. 12 discloses SEQ ID NOS 15316-15318, respectively, in order of appearance.

FIG. 13 is a graph depicting results of the first experimental trial of the isothermal DNA amplification assay for Soy Lectin, which empirically confirm assay performance prediction. Target specific amplification was observed in reactions containing soy genomic DNA. No amplification was observed in no target control reactions. FIG. 13 discloses SEQ ID NOS 15319-15321, respectively, in order of appearance.

FIG. 14 depicts the design of an isothermal DNA amplification assay for pathogenic *Salmonella enterica* invA gene from a single pair of predicted optimal primer structures and a single predicted optimal probe without screening a multitude of candidate primer combinations of unknown performance. FIG. 14 discloses SEQ ID NOS 15322-15324, respectively, in order of appearance.

FIG. 15 is a graph depicting results of the first experimental trial of the isothermal DNA amplification assay for pathogenic *Salmonella enterica* invA gene, which empirically confirm assay performance prediction. Target specific amplification was observed in reactions containing soy genomic DNA. No amplification was observed in no target control reactions. FIG. 15 discloses SEQ ID NOS 15325-15328, respectively, in order of appearance.

FIG. 16 includes two graphs showing that the isothermal DNA amplification assay for *Salmonella enterica* invA gene is readily optimized.

FIG. 17A is a graph plotting $\Delta\Delta G$ in kcal/mol of first primer region (5'-tail) self-self dimer of working assay primers and failed assay primers against $\Delta\Delta G$ in kcal/mol of second primer region/target hybrid duplex. Clustering of working assay primers and failed assay primers showed correlation with function/non-function. FIG. 17B is a graph plotting length in bases of second primer target-complementary region of working assay primers and failed assay primers against % GC content of second primer target-complementary region. Working assay primers and failed assay primers showed a random distribution. FIG. 17C is a graph plotting length in bases of second primer target-complementary region of working assay primers and failed assay primers against $\Delta G$ in kcal/mol of second primer region/target hybrid duplex. Working assay primers and failed assay primers showed a random distribution. FIG. 17D is a graph plotting $T_M$ in ° C. of second primer region/target hybrid duplex of working assay primers and failed assay primers against $\Delta G$ in kcal/mol of second primer region/target hybrid duplex. Working assay primers and failed assay primers showed no correlation with function/non-function. FIG. 17E is a graph plotting $\Delta G$ in kcal/mol of most favored second primer region/off-target hybrid duplex of working assay primers and failed assay primers against $\Delta G$ in kcal/mol of primer region/target hybrid duplex. Working assay primers and failed assay primers showed a random distribution. FIG. 17F is a graph plotting % GC content of second primer region of working assay primers and failed assay primers against $T_M$ in ° C. of second primer region/target hybrid duplex. Working assay primers and failed assay primers showed a random distribution. FIG. 17G is a graph plotting % GC content of second primer region of working assay primers and failed assay primers against $\Delta G$ in kcal/mol of second primer region/target hybrid duplex. Working assay primers and failed assay primers showed a random distribution. FIG. 17H is a graph plotting % GC content of second primer region of working assay primers and failed assay primers against $T_M$ in ° C. of second primer region/target hybrid duplex. Working assay primers and failed assay primers showed a random distribution. FIG. 17I is a graph plotting length in bases of primer (3' target recognition region) of working assay primers and failed assay primers against $T_M$ in ° C. of primer-target hybrid duplex. Working assay primers and failed assay primers showed a random distribution.

DETAILED DESCRIPTION OF THE INVENTION

The invention methods that are useful for the predictable design of primers, and methods of using such primers for the amplification of a target nucleic acid molecule in a nucleic acid amplification reaction. The compositions and methods are also useful for the amplification and detection of a target nucleic acid molecule in a nucleic acid amplification reaction, including in a nicking amplification reaction.

The invention is based, at least in part, on several discoveries relating to oligonucleotides used in nucleic amplification reactions, including primers and probes, and their effect on enhancing or enabling nucleic acid amplification reactions. Applicants were the first to appreciate that one or more of these discoveries in combination could be applied to design primers and probes for nucleic acid amplification reactions and/or detection assays.

The invention is based, at least in part, on the discovery that oligonucleotides (e.g., primers and probes) in certain configurations have the potential to enhance nucleic acid amplification reaction performance, and that the ability of the oligonucleotides to adopt favorable configurations can be determined by examining the difference in free energy change ($\Delta G$) between desired specific oligonucleotide-target sequence hybrids and various non-specific intramolecular (partially double-stranded monomers) and intermolecular complexes (primer-primer and primer-probe dimers, off-target hybrids) of the oligonucleotide. To date, primer and probe design has not employed the difference in free energy change between target-specific and non-specific primer and probe structures as a score ranking tool to identify the most suitable primer/probe set for a target sequence amplification assay. Application of the foregoing considerations to primer design results in the design of primers that function predictably, minimizing or eliminating the need for empirical testing. Accordingly, the invention provides methods for primer sequence selection, primer modification, and/or probe design that facilitates operational nucleic acid amplification and detection reactions.

Figure 11:
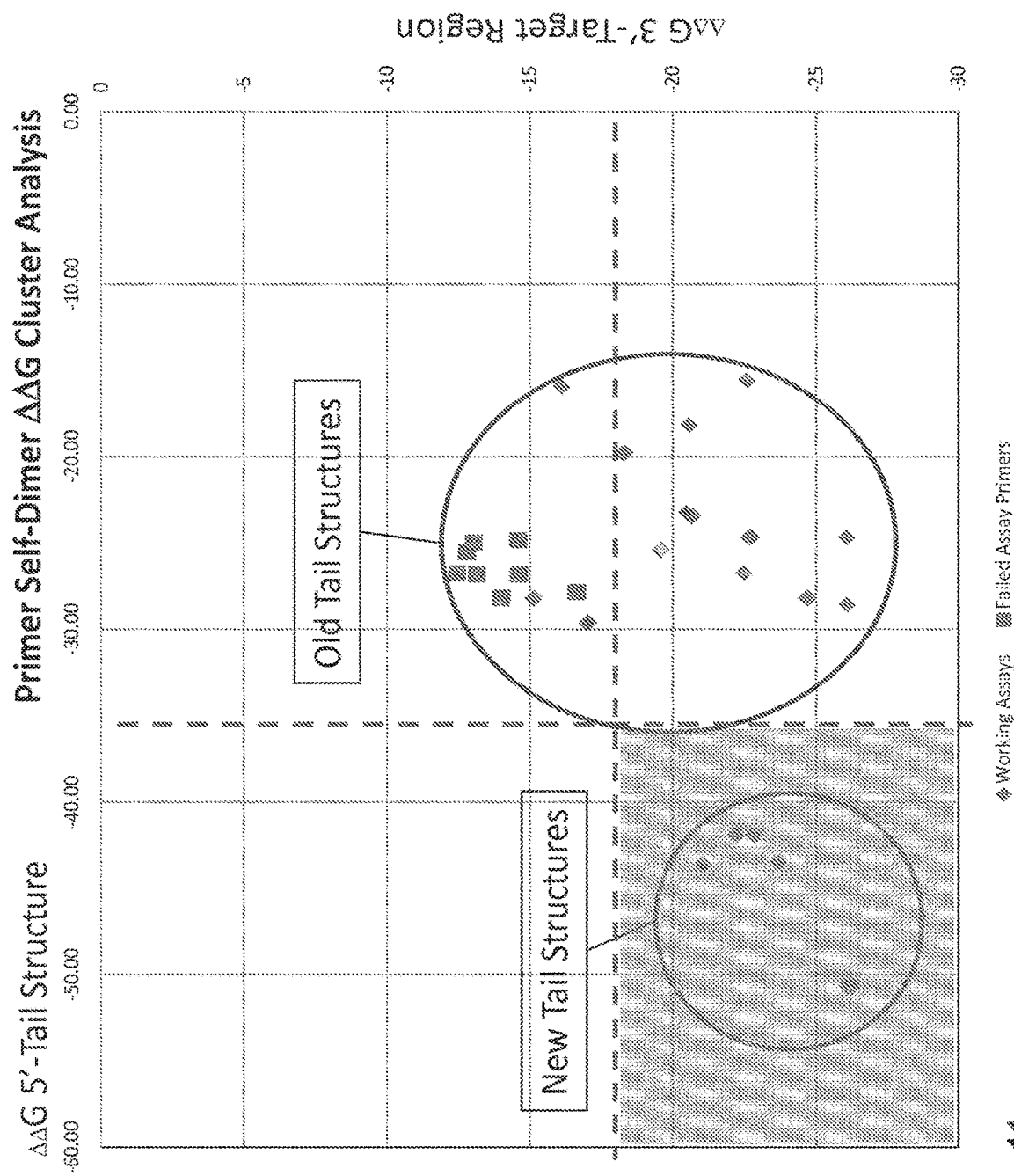
FIG. 11 is a graph of working and failed assay primers plotted according to their relative stabilities. Primers having a 3' recognition region having a $\Delta\Delta G\leq$about $-16$ kcal/mole were observed to work in nicking amplification assays, while primers having a $\Delta\Delta G>$about $-16$ were prone to failure. Primers having a 3' recognition region having a $\Delta\Delta G\leq$about $-16$ kcal/mole and a 5' tail having a $\Delta\Delta G\leq$about $-30$ kcal/mole were all observed to work.

Applicants have discovered that a primer having a 3' recognition sequence whose primer-target formation is stable (e.g., $\Delta G_{25°\,C.} \leq$ about $-20$ kcal/mol or more) has the potential to enhance nucleic acid amplification reaction performance. In particular embodiments, the 3' target recognition sequence comprises 12-24, 12-17, or 12-14 bases. In particular embodiments, the primer-target formation is more stable than self dimer formation (e.g., $\Delta\Delta G \leq$ about $-15$, $-16$, $-17$, $-18$, $-19$, $-20$ kcal/mol or more). Indeed, it has been found that a difference between a working and non-working assay is when the $\Delta\Delta G <$ about $-15$ kcal/mol (see, e.g., FIG. 11).

Additionally, Applicants have discovered that a primer having a 5' tail region capable of self-dimerization enhances nucleic acid amplification reaction performance. Without being bound to theory, in a nucleic acid amplification reaction the primer anneals to the target nucleic acid as a primer-dimer (see e.g., FIG. 1). Surprisingly and unexpectedly, this primer-dimer configuration does not detectably interfere with polymerase activity, and reduces or prevents non-specific interaction of the 5' portion of the primer with itself or other nucleic acid molecules. The 5' tail region comprises a perfect palindrome sequence, through which monomer primers can dimerize. For example, primers have a nicking agent recognition site present at the 5' end that is unrelated to the binding specificity of the primer for the target recognition sequence. Non-specific background products from non-specific primer interactions have the potential to sequester reaction components that would otherwise have been utilized for the amplification of the specific product. In various embodiments, homodimer formation is stable (e.g., $\Delta G_{25° C.} \le$ about −30, −35, −40, −45, −50, −55, −60 kcal/mol or more). In various embodiments, the homodimer has a melting temperature higher than the extension reaction temperature. In particular embodiments, the 5' tail region has a sequence that is a palindrome. In further embodiments, the 5' tail region is at least 20 bases (e.g., 20, 21, 22, 23, 24 bases) in length. In additional embodiments, the 5' tail region has a GC content of 80-90%. In certain embodiments, homodimer formation is more stable than formation of other less stable primer dimer conformations ($\Delta\Delta G \le$ about −15, −20, −25, −30, −35, −40 kcal/mol or more).

Further, Applicants have discovered that primers comprising a 2' modified nucleotide (e.g., 2'-O-methyl, 2'-Fluoro, 2'-alkyl) at the 3' end of the 3' recognition region reduce or eliminate non-specific background products. This increases the generation of specific products in nucleic acid amplification reactions without the generation of background products. In various embodiments, one or more of the nucleotides in the 3' recognition region comprises a modified nucleobase that destabilizes mismatched base pairs. In particular embodiments, a modified nucleobase is in two or more continuous nucleotides starting at position 1, 2, 3, 4, 5, or 6 from the 3' terminus, where position 1 is the nucleotide at the 3' terminus. In specific embodiments, no fewer than 8 and no more than 10 unmodified nucleotides are positioned between the first 5' nucleotide of the 3' recognition region and the nearest 3' modified nucleotide.

In specific embodiments, the primer comprises a 3' recognition region and a 5' tail dimerization region. Under reaction conditions, monomer primers dimerize to form primer-dimers by binding of their 5' tail dimerization regions. Without being bound to theory, a single-stranded 3' recognition region of the primer-dimer anneals the target nucleic acid molecule and synthesizes the complementary target strand. A monomer primer is released from the extended strand by polymerase strand displacement action from synthesis of the complementary strand. The released monomer primer dimerizes with another free monomer by 5' tail region binding. Multiple cycles result in exponential target nucleic acid amplification.

Primer Design

Conventional methods for primer design have focused on primer melting temperature, primer annealing temperature, GC (guaninine and cytosine) content, primer length, and minimizing interactions of the primer with all but the target nucleic acid (see e.g., premier biosoft primer design website). Contrary to these methods, it has been found that primers that form stable primer/dimers, expressed in terms of free energy of formation ($\Delta G$), function predictably in nucleic acid amplification reactions. While Free Energy ($\Delta G$) and Melting Temperature (Tm) share primary components Enthalpy ($\Delta H$) and Entropy ($\Delta S$), $\Delta G$ and Tm values are derived differently and have no correlative relationship, and the only way to relate a given $\Delta G$ with a given Tm value is to explicitly know the value of $\Delta H$ and $\Delta S$ from which they are derived (Manthey, "mFold, Delta G, and Melting Temperature" ©2005 and 2011 Integrated DNA Technologies). FIGS. 1-11 relate to the design of optimal primers.

The free energy of formation ($\Delta G$) for intermolecular primer structures may be calculated using formulas known in the art. A number of programs are available for determining the formation of various intramolecular and intermolecular primer structures and calculating their $\Delta G$'s, including for example mfold and UNAfold prediction algorithms (see e.g., Markham and Zuker. UNAFold: Software for Nucleic Acid Folding and Hybridization. Bioinformatics: Volume 2, Chapter 1, pp 3-31, Humana Press Inc., 2008; Zuker et al. Algorithms and Thermodynamics for RNA Secondary Structure Prediction: A Practical Guide In RNA Biochemistry and Biotechnology, 11-43, NATO ASI Series, Kluwer Academic Publishers, 1999; M. Zuker. Prediction of RNA Secondary Structure by Energy Minimization. Methods in Molecular Biology, 267-294, 1994; Jaeger et al. Predicting Optimal and Suboptimal Secondary Structure for RNA. In Molecular Evolution: Computer Analysis of Protein and Nucleic Acid Sequences, Methods in Enzymology 183, 281-306, 1990; Zuker. On Finding All Suboptimal Foldings of an RNA Molecule. Science 244, 48-52, 1989). OligoAnalyzer 3.1 is one such implementation of mfold for primer design (see the OligoAnalyzer Tool from Integrated DNA Technologies website). For example with reference to OligoAnalyzer 3.1, $\Delta G$ calculations may be performed using the following parameters: Target Type: DNA; Oligo Concentration 0.25 µM; $Na^+$ Concentration: 60 mM; $Mg^{++}$ Concentration: 15 mM; and dNTPs Concentration: 0.3 mM.

3' Recognition Region

The invention provides a primer having a 3' recognition sequence whose primer-target formation is stable ($\Delta G \le$ about −20 kcal/mol or more) has the potential to enhance nucleic acid amplification reaction performance. The 3' recognition region specifically binds to the a target nucleic acid, for example a complementary sequence of the target nucleic acid. In certain embodiments, the 3' recognition region has a sequence that is complementary to 12, 13, 14, 15, 16, 17, 18, 19, or 20 bases or more of a target nucleic acid sequence. In various embodiments, the primer-target melting temperature is equal to or greater than 8° or 6° C. below the reaction or extension temperature of the assay (Tm≥assay temperature−8°). In particular embodiments, the 3' recognition sequence comprises 12-20, 12-17, or 12-14 nucleotides. In particular embodiments, the primer-target formation is more stable than self dimer formation (e.g., $\Delta\Delta G \le$ about −15, −16, −17, −18, −19, −20 kcal/mol or more). Indeed, it has been found that a difference between a working and non-working assay is when the $\Delta\Delta G <$ about −15 kcal/mol (see, e.g., FIG. 11). Preferably, the 3' recognition sequence does not contain self-complementary sequences, short inverted repeats (e.g., >4 bases/repeat), or sequences that otherwise promote intramolecular interactions, which have the potential to interfere with primer-target annealing.

In particular, a primer of the invention having a 3' recognition sequence is useful in nicking amplification assays. Additionally, the target specific 3' recognition region comprises one or more 2' modified nucleotides (e.g., 2'-O-methyl, 2'-methoxyethoxy, 2'-fluoro, 2'-alkyl, 2'-allyl, 2'-O-[2-(methylamino)-2-oxoethyl], 2'-hydroxyl (RNA), 4'-thio, 4'-CH$_2$—O-2'-bridge, 4'-(CH$_2$)$_2$—O-2'-bridge, and 2'-O—(N-methylcarbamate)). Without being bound to theory, it is hypothesized that incorporating one or more 2' modified nucleotides in the recognition regions reduces or eliminates intermolecular and/or intramolecular interactions of primers (e.g., primer-dimer formation), and, thereby, reduces or eliminates the background signal in isothermal amplification. The 2' modified nucleotide preferably has a base that base pairs with the target sequence. In particular embodiments, two or more 2' modified nucleotides (e.g., 2, 3, 4, 5 or more 2' modified nucleotides) in the target specific recognition region are contiguous (e.g., a block of modified nucleotides). In some embodiments, the block of 2' modified nucleotides is positioned at the 3' end of the target specific recognition region. In other embodiments, the block of 2' modified nucleotides is positioned at the 5' end of the target specific recognition region. When the block of 2' modified nucleotides is positioned at the 5' end of the target specific recognition region, the 2' modified nucleotides may be separated from the nick site by one or more non-modified nucleotides (e.g., 2, 3, 4, 5 or more 2' unmodified nucleotides). Applicants have found that positioning of one or more 2' modified nucleotides or of a block of 2' modified nucleotides alters the kinetics of amplification. When the one or more 2' modified nucleotides or block of 2' modified nucleotides are positioned at or near the 5' end of the recognition region or proximal to the nick site, real-time amplification reactions showed decreased time to detection. Additionally, the signal curve is contracted and the slope of the curve shifted.

In a related embodiment, ratios of a primer having one or more 2' modified nucleotides can be used to alter the time-to-detection and/or the efficiency of the reaction for the 'tuning' of reactions, resulting in a predictable control over reaction kinetics. Increasing the ratio of primer having one or more 2' modified nucleotides at the 3' end of the recognition sequence to primer having one or more 2' modified nucleotides at the 5' end of the recognition sequence contracted the signal curve and shifted the slope of the curve. It is advantageous to be able to "tune" a reaction providing a means to manipulate both the time-to-detection as well as the efficiency of the reaction. Tuning the reactions can be used to match efficiencies of target nucleic acid amplification and reference nucleic amplification (e.g., internal standard) in quantitative PCR (qPCR). Additionally, amplification curves of the target nucleic acid and the internal standard may be altered so time of detection of their amplification products are separated, while providing the same efficiency for target nucleic acid amplification and internal standard amplification. Through the use of specific combinations and ratios of oligonucleotide structures within a reaction it is possible to create conditions which enable tuned reaction performance.

5' Tail Dimerization Region

The invention provides a primer having a 5' tail region capable of self-dimerization that enhances nucleic acid amplification reaction performance. Without being bound to theory, in a nucleic acid amplification reaction the primer anneals to the target nucleic acid as a primer-dimer (see e.g., FIG. 1). For example, nicking amplification primers have a nicking agent recognition site present at the 5' end that is unrelated to the binding specificity of the primer for the target recognition sequence. Non-specific background products from non-specific primer interactions have the potential to sequester reaction components that would otherwise have been utilized for the amplification of the specific product. In various embodiments, homodimer formation is stable (e.g., $\Delta G \leq$ about $-30, -35, -40, -45, -50, -55, -60$ kcal/mol or more). In various embodiments, the homodimer has a melting temperature higher than the extension reaction temperature. In particular embodiments, the 5' tail region has a sequence that is a palindrome. In further embodiments, the 5' tail region is at least 12 bases (e.g., 12, 13, 14, 15, 16, 17, 18, 19, 20, 21, 22, 23, 24 bases) in length. In additional embodiments, the 5' tail region has a GC content of 80-90%. In certain embodiments, homodimer formation is more stable than formation of other less stable primer dimer conformations formation (e.g., $\Delta\Delta G \leq$ about $-12, -13, -14, -15, -16, -17, -18, -19, -20, -25, -30, -35, -40$ kcal/mol or more).

In particular, a primer of the invention having a 5' tail sequence is useful in nicking amplification reactions. For use in nicking amplification reactions, the 5' tail region comprises one or more nicking agent recognition sites and the 5' tail region has a symmetrically inverted sequence. In some embodiments, the nick site is designed to be positioned between the nucleotide at the 3' end of the 5' tail region and the nucleotide at the 5' end of the 3' recognition region. Without being bound to theory, the nicking enzyme does not cleave at the nick site when the 3' recognition is single-stranded. However, cleavage at the nick site occurs when the 3' recognition region is double stranded (e.g., when the primer is incorporated into a double-stranded target nucleic acid molecule during the course of the nucleic acid amplification reaction).

In various embodiments, the 5' tail sequence comprises from 5' to 3' an inverted nicking enzyme recognition sequence that is operatively linked to a palindromic sequence (or self-complementary sequence) that is operatively linked to a nicking enzyme recognition sequence. In certain embodiments, the spacer region is an even number of nucleotides (e.g., 2, 4, 6, etc.).

An exemplary 5' tail based on the Nt.BstNBI nicking enzyme recognition sequence (5'-GAGTC-3') having a 2 nucleotide spacer comprises a nucleic acid sequence according to the formula below:

5'-<u>GACTC</u>N$_1$N$_1$·<u>GAGTC</u>-3'     (SEQ ID NO: 15241)

where "N" is any nucleotide (e.g., having an adenine (A), thymine (T), cytosine (C), or guanine (G) nucleobase), and N$_1$ is complementary to N$_{1'}$.

Exemplary sequences for such 2 base spacer tail sequences comprise, for example, the nucleic acid sequences according to the formulas below:

5'-<u>GACTC</u>N$_1$N$_{1'}$·<u>GAGTC</u>-3';     (SEQ ID NO: 15241)

5'-<u>GACTC</u>N$_1$N$_{1'}$·<u>GAGTC</u>N-3';     (SEQ ID NO: 15242)

5'-N$_2$<u>GACTC</u>N$_1$N$_{1'}$·<u>GAGTC</u>N$_{2'}$·-3';     (SEQ ID NO: 15243)

5'-N$_2$<u>GACTC</u>N$_1$N$_{1'}$·<u>GAGTC</u>N$_{2'}$·N-3';     (SEQ ID NO: 15244)

5'-N$_3$N$_2$<u>GACTC</u>N$_1$N$_{1'}$·<u>GAGTC</u>N$_{2'}$·N$_{3'}$·-3';     (SEQ ID NO: 15245)

5'-N$_3$N$_2$<u>GACTC</u>N$_1$N$_{1'}$·<u>GAGTC</u>N$_{2'}$·N$_{3'}$·N-3';     (SEQ ID NO: 15246)

5'-N$_4$N$_3$N$_2$<u>GACTC</u>N$_1$N$_{1'}$·<u>GAGTC</u>N$_{2'}$·N$_{3'}$·N$_{4'}$·-3';     (SEQ ID NO: 15247)

5'-N$_4$N$_3$N$_2$<u>GACTC</u>N$_1$N$_{1'}$·<u>GAGTC</u>N$_{2'}$·N$_{3'}$·N$_{4'}$·N-3';     (SEQ ID NO: 15248)
and 5'-N$_5$N$_4$N$_3$N$_2$<u>GACTC</u>N$_1$N$_{1'}$·<u>GAGTC</u>N$_{2'}$·N$_{3'}$·N$_{4'}$·N$_{5'}$·-3',     (SEQ ID NO: 15249)

where "N" is any nucleotide (e.g., having an adenine (A), thymine (T), cytosine (C), or guanine (G) nucleobase), and N$_1$ is complementary to N$_{1'}$, N$_2$ to N$_{2'}$, N$_3$ to N$_{3'}$, N$_4$ to N$_{4'}$, and N$_5$ to N$_{5'}$, etc.

In some embodiments, 2 base spacer tails exclude those comprising the nucleic acid sequences according to the formulas below:

5'-TCGACTCN$_1$N$_1$,GAGTCGA-3'; (SEQ ID NO: 15273)

5'-TCGACTCN$_1$N$_1$,GAGTCGAN-3'; (SEQ ID NO: 15274)

5'-N$_2$TCGACTCN$_1$N$_1$,GAGTCGAN$_2$,-3'; (SEQ ID NO: 15275)

5'-N$_2$TCGACTCN$_1$N$_1$,GAGTCGAN$_2$,N-3'; (SEQ ID NO: 15276)

5'-GTCGACTCN$_1$N$_1$,GAGTCGAC-3'; (SEQ ID NO: 15277)

5'-GTCGACTCN$_1$N$_1$,GAGTCGACN-3'; (SEQ ID NO: 15278)

5'-N$_3$N$_2$TCGACTCN$_1$N$_1$,GAGTCGAN$_2$,N$_3$,-3'; (SEQ ID NO: 15279)

5'-N$_3$GTCGACTCN$_1$N$_1$,GAGTCGACN$_3$,-3'; and (SEQ ID NO: 15280)

5'-AGTCGACTCN$_1$N$_1$,GAGTCGACT-3', (SEQ ID NO: 15281)

where "N" is any nucleotide (e.g., having an adenine (A), thymine (T), cytosine (C), or guanine (G) nucleobase), and N$_1$ is complementary to N$_1'$, N$_2$ to N$_2'$, N$_3$ to N$_3'$, etc.

An exemplary 5' tail based on the Nt.BstNBI nicking enzyme recognition sequence (5'-GAGTC-3') having a 4 nucleotide spacer comprises a nucleic acid sequence according to the formula below:

5'-GACTCN$_2$N$_1$N$_1$,N$_2$,GAGTC-3' (SEQ ID NO: 15250)

where "N" is any nucleotide (e.g., having an adenine (A), thymine (T), cytosine (C), or guanine (G) nucleobase), and N$_1$ is complementary to N$_1'$, and N$_2$ is complementary to N$_2'$.

Exemplary sequences for such 4 base spacer tail sequences include, for example, the nucleic acid sequences according to the formulas below:

5'-GACTCN$_2$N$_1$N$_1$,N$_2$,GAGTC-3'; (SEQ ID NO: 15250)

5'-GACTCN$_2$N$_1$N$_1$,N$_2$,GAGTCN-3'; (SEQ ID NO: 15251)

5'-N$_3$GACTCN$_2$N$_1$N$_1$,N$_2$,GAGTCN$_3$,-3'; (SEQ ID NO: 15252)

5'-N$_3$GACTCN$_2$N$_1$N$_1$,N$_2$,GAGTCN$_3$,N-3'; (SEQ ID NO: 15253)

5'-N$_4$N$_3$GACTCN$_2$N$_1$N$_1$,N$_2$,GAGTCN$_3$,N$_4$,-3'; (SEQ ID NO: 15254)

5'-N$_4$N$_3$GACTCN$_2$N$_1$N$_1$,N$_2$,GAGTCN$_3$,N$_4$,N-3'; (SEQ ID NO: 15255)

5'-N$_5$N$_4$N$_3$GACTCN$_2$N$_1$N$_1$,N$_2$,GAGTCN$_3$,N$_4$,N$_5$,-3'; (SEQ ID NO: 15256)

5'-N$_5$N$_4$N$_3$GACTCN$_2$N$_1$N$_1$,N$_2$,GAGTCN$_3$,N$_4$,N$_5$,N-3'; and (SEQ ID NO: 15257)

5'-N$_6$N$_5$N$_4$N$_3$GACTCN$_2$N$_1$N$_1$,N$_2$,GAGTCN$_3$,N$_4$,N$_5$,N$_6$,-3', (SEQ ID NO: 15258)

where "N" is any nucleotide (e.g., having an adenine (A), thymine (T), cytosine (C), or guanine (G) nucleobase), and N$_1$ is complementary to N$_1'$, N$_2$ to N$_2'$, N$_3$ to N$_3'$, N$_4$ to N$_4'$, N$_5$ to N$_5'$, and N$_6$ to N$_6'$, etc.

In some embodiments, 4 base spacer tails exclude those comprising the nucleic acid sequences according to the formulas below:

5'-GACTCGATCGAGTC-3'; (SEQ ID NO: 15282)

5'-GAGTCGATCGAGTCN-3'; (SEQ ID NO: 15283)

5'-N$_1$GACTCGATCGAGTCN$_1$,-3'; (SEQ ID NO: 15284)

5'-N$_1$GACTCGATCGAGTCN$_1$,N-3'; (SEQ ID NO: 15285)

5'-N$_2$N$_1$GACTCGATCGAGTCN$_1$,N$_2$,-3'; (SEQ ID NO: 15286)

5'-N$_2$N$_1$GACTCGATCGAGTCN$_1$,N$_2$,N-3'; (SEQ ID NO: 15287)

5'-TCGACTCN$_2$N$_1$N$_1$,N$_2$,GAGTCGA-3'; (SEQ ID NO: 15288)

5'-TCGACTCN$_2$N$_1$N$_1$,N$_2$,GAGTCGAN-3'; (SEQ ID NO: 15289)

5'-N$_3$N$_2$N$_1$GACTCGATCGAGTCN$_1$,N$_2$,N$_3$,-3'; (SEQ ID NO: 15290)

5'-N$_3$N$_2$N$_1$GACTCGATCGAGTCN$_1$,N$_2$,N$_3$,N-3'; (SEQ ID NO: 15291)

5'-N$_3$TCGACTCN$_2$N$_1$N$_1$,N$_2$,GAGTCGAN$_3$,-3'; (SEQ ID NO: 15292)

5'-N$_3$TCGACTCN$_2$N$_1$N$_1$,N$_2$,GAGTCGAN$_3$,N-3'; (SEQ ID NO: 15293)

5'-GTCGACTCN$_2$N$_1$N$_1$,N$_2$,GAGTCGAC-3'; (SEQ ID NO: 15294)

5'-GTCGACTCN$_2$N$_1$N$_1$,N$_2$,GAGTCGACN-3'; (SEQ ID NO: 15295)

5'-N$_4$N$_3$N$_2$N$_1$GACTCGATCGAGTCN$_1$,N$_2$,N$_3$,N$_4$,-3'; (SEQ ID NO: 15296)

5'-N$_4$N$_3$TCGACTCN$_2$N$_1$N$_1$,N$_2$,GAGTCGACN$_3$,N$_4$,-3'; (SEQ ID NO: 15207)

5'-N$_3$GTCGACTCN$_2$N$_1$N$_1$,N$_2$,GAGTCGACN$_3$,-3'; and (SEQ ID NO: 15298)

5'-AGTCGACTCN$_2$N$_1$N$_1$,N$_2$,GAGTCGACT-3', (SEQ ID NO: 15299)

where "N" is any nucleotide (e.g., having an adenine (A), thymine (T), cytosine (C), or guanine (G) nucleobase), and N$_1$ is complementary to N$_1'$, N$_2$ to N$_2'$, N$_3$ to N$_3'$, etc.

An exemplary 5' tail based on the Nt.BstNBI nicking enzyme recognition sequence (5'-GAGTC-3') having a 6 nucleotide spacer comprises a nucleic acid sequence according to the formula below:

5'-GACTCN$_3$N$_2$N$_1$N$_1$,N$_2$,N$_3$,GAGTC-3' (SEQ ID NO: 15259)

where "N" is any nucleotide (e.g., having an adenine (A), thymine (T), cytosine (C), or guanine (G) nucleobase), and N$_1$ is complementary to N$_1'$, N$_2$ is complementary to N$_2'$, and N$_3$ is complementary to N$_3'$.

Exemplary sequences for such 6 base spacer tail sequences comprise, for example, the nucleic acid sequences according to the formulas below:

(SEQ ID NO: 15259)
5'-GACTCN$_3$N$_2$N$_1$N$_1$,N$_2$,N$_3$,GAGTC-3';

(SEQ ID NO: 15260)
5'-GACTCN$_3$N$_2$N$_1$N$_1$,N$_2$,N$_3$,GAGTCN-3';

(SEQ ID NO: 15261)
5'-GACTCN$_3$N$_2$N$_1$N$_1$,N$_2$,N$_3$,GAGTCNN-3';

(SEQ ID NO: 15262)
5'-GACTCN$_3$N$_2$N$_1$N$_1$,N$_2$,N$_3$,GAGTCNNN-3';

(SEQ ID NO: 15263)
5'-GACTCN$_3$N$_2$N$_1$N$_1$,N$_2$,N$_3$,GAGTCNNNN-3';

(SEQ ID NO: 15264)
5'-N$_4$GACTCN$_3$N$_2$N$_1$N$_1$,N$_2$,N$_3$,GAGTCN$_4'$,-3';

(SEQ ID NO: 15265)
5'-N$_4$GACTCN$_3$N$_2$N$_1$N$_1$,N$_2$,N$_3$,GAGTCN$_4'$,N-3';

(SEQ ID NO: 15266)
5'-N$_4$GACTCN$_3$N$_2$N$_1$N$_1$,N$_2$,N$_3$,GAGTCN$_4'$,NN-3';

(SEQ ID NO: 15267)
5'-N$_4$GACTCN$_3$N$_2$N$_1$N$_1$,N$_2$,N$_3$,GAGTCN$_4'$,NNN-3';

(SEQ ID NO: 15268)
5'-N$_5$N$_4$GACTCN$_3$N$_2$N$_1$N$_1$,N$_2$,N$_3$,GAGTCN$_4'$,N$_5'$,-3';

(SEQ ID NO: 15269)
5'-N$_5$N$_4$GACTCN$_3$N$_2$N$_1$N$_1$,N$_2$,N$_3$,GAGTCN$_4'$,N$_5'$,N-3';

(SEQ ID NO: 15270)
5'-N$_6$N$_5$N$_4$GACTCN$_3$N$_2$N$_1$N$_1$,N$_2$,N$_3$,GAGTCN$_4'$,N$_5'$,N$_6'$,-3';

(SEQ ID NO: 15271)
5'-N$_6$N$_5$N$_4$GACTCN$_3$N$_2$N$_1$N$_1$,N$_2$,N$_3$,GAGTCN$_4'$,N$_5'$,N$_6'$,N-3';
and (SEQ ID NO: 15272)
5'-N$_7$N$_6$N$_5$N$_4$GACTCN$_3$N$_2$N$_1$N$_1$,N$_2$,N$_3$,GAGTCN$_4'$,N$_5'$,N$_6'$,N$_7'$,-3', where "N" is any nucleotide (e.g., having an adenine (A), thymine (T), cytosine (C), or guanine (G) nucleobase), and N$_1$ is complementary to N$_1'$, N$_2$ to N$_2'$, N$_3$ to N$_3'$, N$_4$ to N$_4'$, N$_5$ to N$_5'$, N$_6$ to N$_6'$, and N$_7$ to N$_7'$, etc.

In some embodiments, 6 base spacer tails exclude those having the nucleic acid sequences according to the formulas below:

(SEQ ID NO: 15300)
5'-GACTCGAN$_1$N$_1'$,TCGAGTC-3';

(SEQ ID NO: 15301)
5'-GACTCGAN$_1$N$_1'$,TCGAGTCN-3';

(SEQ ID NO: 15302)
5'-N$_2$GACTCGAN$_1$N$_1'$,TCGAGTCN$_2'$,-3';

(SEQ ID NO: 15303)
5'-N$_2$GACTCGAN$_1$N$_1'$,TCGAGTCN$_2'$,N-3';

(SEQ ID NO: 15304)
5'-N$_3$N$_2$GACTCGAN$_1$N$_1'$,TCGAGTCN$_2'$,N$_3'$,-3';

(SEQ ID NO: 15305)
5'-N$_3$N$_2$GACTCGAN$_1$N$_1'$,TCGAGTCN$_2'$,N$_3'$,N-3';

(SEQ ID NO: 15306)
5'-TCGACTCN$_3$N$_2$N$_1$N$_1'$,N$_2'$,N$_3'$,GAGTCGA-3';

(SEQ ID NO: 15307)
5'-TCGACTCN$_3$N$_2$N$_1$N$_1'$,N$_2'$,N$_3'$,GAGTCGAN-3';

(SEQ ID NO: 15308)
5'-N$_4$N$_3$N$_2$GACTCGAN$_1$N$_1'$,TCGAGTCN$_2'$,N$_3'$,N$_4'$,-3';

(SEQ ID NO: 15309)
5'-N$_4$N$_3$N$_2$GACTCGAN$_1$N$_1'$,TCGAGTCN$_2'$,N$_3'$,N$_4'$,N-3';

(SEQ ID NO: 15310)
5'-N$_4$GTCGACTCN$_3$N$_2$N$_1$N$_1'$,N$_2'$,N$_3'$,GAGTCGACN$_4'$,-3';

(SEQ ID NO: 15311)
5'-GTCGACTCN$_3$N$_2$N$_1$N$_1'$,N$_2'$,N$_3'$,GAGTCGAC-3';

(SEQ ID NO: 15312)
5'-GTCGACTCN$_3$N$_2$N$_1$N$_1'$,N$_2'$,N$_3'$,GAGTCGACN-3';

(SEQ ID NO: 15313)
5'-N$_5$N$_4$N$_3$N$_2$GACTCGAN$_1$N$_1'$,TCGAGTCN$_2'$,N$_3'$,N$_4'$,N$_5'$,-3';

(SEQ ID NO: 15314)
5'-N$_5$N$_4$TCGACTCN$_3$N$_2$N$_1$N$_1'$,N$_2'$,N$_3'$,GAGTCGAN$_4'$,N$_5'$,-3';

(SEQ ID NO: 15310)
5'-N$_4$GTCGACTCN$_3$N$_2$N$_1$N$_1'$,N$_2'$,N$_3'$,GAGTCGACN$_4'$,-3';
and (SEQ ID NO: 15315)
5'-AGTCGACTCN$_3$N$_2$N$_1$N$_1'$,N$_2'$,N$_3'$,GAGTCGACT-3', where "N" is any nucleotide (e.g., having an adenine (A), thymine (T), cytosine (C), or guanine (G) nucleobase), and N$_1$ is complementary to N$_1'$, N$_2$ to N$_2'$, N$_3$ to N$_3'$, N$_4$ to N$_4'$, N$_5$ to N$_5'$, etc.

Exemplary 5' tail region sequences are provided at FIGS. 8A-8E. Exemplary 5' tail region sequences 24 nucleotides in length having a Nt.BstNBI recognition sequence can be generated based on the following template 5'-NNNNGACTCNNNNNNGAGTCNNNN-3' (SEQ ID NO: 15272) (FIG. 8A). Based on this template, there are 537,824 5' tail sequences having the following properties: ΔG=−48 Kcal/mole to −62 kcal/mole; ΔΔG<−40 kcal/mole; and GC content 68% to 84%. Of these, 1050 selected sequences are provided, representing 0.2% of the entire sequence space (248,832). Exemplary 5' tail region sequences 22 nucleotides in length having a Nt.BstNBI recognition sequence and based on the following template 5'-NNNNGACTCNNNNGAGTCNNNN-3' (SEQ ID NO: 15258) (FIG. 8B). Based on this template, there are 248,832 5' tail sequences having the following properties: ΔG=−47 Kcal/mole to −55 kcal/mole; ΔΔG<−40 kcal/mole; and GC content 72% to 82%. Of these, 200 selected sequences are provided, representing 0.08% of the entire sequence space (248,832).

Nucleic Amplification Methods

Nucleic acid amplification technologies have provided a means of understanding complex biological processes, detection, and identification, of pathogenic and non-pathogenic organisms, forensic criminology analysis, disease association studies, and detection of events in genetically modified organisms, etc. The polymerase chain reaction (PCR) is a common thermal cycling dependent nucleic acid amplification technology used to amplify DNA consisting of cycles of repeated heating and cooling of the reaction for DNA melting and enzymatic replication of the DNA using a DNA polymerase. Real-Time quantitative PCR (qPCR) is a technique used to quantify the number of copies of a given nucleic acid sequence in a biological sample. Currently, qPCR utilizes the detection of reaction products in real-time throughout the reaction and compares the amplification profile to the amplification of controls which contain a known quantity of nucleic acids at the beginning of each reaction (or a known relative ratio of nucleic acids to the unknown tested nucleic acid). The results of the controls are used to construct standard curves, typically based on the logarithmic portion of the standard reaction amplification curves. These values are used to interpolate the quantity of the unknowns based on where their amplification curves compared to the standard control quantities.

In addition to PCR, non-thermal cycling dependent amplification systems or isothermal nucleic acid amplification technologies exist including, without limitation: Nicking Amplification Reaction, Rolling Circle Amplification (RCA), Helicase-Dependent Amplification (HDA), Loop-Mediated Amplification (LAMP), Strand Displacement Amplification (SDA), Transcription-Mediated Amplification (TMA), Self-Sustained Sequence Replication (3 SR), Nucleic Acid Sequence Based Amplification (NASBA), Single Primer Isothermal Amplification (SPIA), Q-β Replicase System, and Recombinase Polymerase Amplification (RPA).

Isothermal nicking amplification reactions have similarities to PCR thermocycling. Like PCR, nicking amplification reactions employ oligonucleotide sequences which are complementary to a target sequences referred to as primers. In addition, nicking amplification reactions of target sequences results in a logarithmic increase in the target sequence, just as it does in standard PCR. Unlike standard PCR, the nicking amplification reactions progress isothermally. In standard PCR, the temperature is increased to allow the two strands of DNA to separate. In nicking amplification reactions, the target nucleic acid sequence is nicked at specific nicking sites present in a test sample. The polymerase infiltrates the nick site and begins complementary strand synthesis of the nicked target nucleotide sequence (the added exogenous DNA) along with displacement of the existing complimentary DNA strand. The strand displacement replication process obviates the need for thermal strand separation. At this point, primer molecules anneal to the displaced complementary sequence from the added exogenous DNA. The polymerase now extends from the 3' end of the primer, creating a complementary strand to the previously displaced strand. The second primer oligonucleotide then anneals to the newly synthesized complementary strand and is extended making a duplex of DNA which includes the nicking agent recognition sequence. This strand is then liable to be nicked with subsequent strand displacement extension by the polymerase, which leads to the production of an interim amplicon of duplex of DNA which has nick sites on either side of the original target DNA. Once this interim amplicon is synthesized, the molecule continues to be amplified exponentially through replication of the displaced strands with new primer molecules. In addition, amplification also proceeds linearly from each product molecule through the repeated action of the nick translation synthesis at the template introduced nick sites. The result is a very rapid increase in target signal amplification; much more rapid than as produced by PCR thermocycling, with amplification results in less than ten minutes.

Nicking Agent-Dependent Isothermal Nucleic Acid Amplification Assays

The invention provides for the detection of target nucleic acid molecules amplified in an isothermal nicking amplification assay. Polymerases useful in the methods described herein are capable of catalyzing the incorporation of nucleotides to extend a 3' hydroxyl terminus of an oligonucleotide (e.g., a primer) bound to a target nucleic acid molecule and/or a 3' hydroxyl terminus at a nick site in a double-stranded DNA molecule in conjunction with strand displacement activity. Such polymerases also lack or have substantially reduced 5'-3' exonuclease activity and may include those that are thermophilic. DNA polymerases useful in methods involving primers having 2'-modified nucleotides in the primer region comprising the six 3'-terminal nucleotides include derivatives and variants of the DNA polymerase I isolated from *Bacillus stearothermophilus*, also classified as *Geobacillus stearothermophilus*, and from closely related bacterial strains, isolates and species comprising the genus *Geobacillus*, which lack or have substantially reduced 5'-3' exonuclease activity and have strand-displacement activity. Exemplary polymerases include, but are not limited to the large fragments of Bst DNA polymerase I, Gst DNA polymerase I, Gka DNA polymerase I.

A nicking agent useful in methods described herein is a chemical entity capable of recognizing and binding to a specific structure in double stranded nucleic acid molecules and cleaving a phosphodiester bond between adjoining nucleotides on the top strand with a substantially higher rate than cleaving the phosphodiester bond between adjoining nucleotides on the bottom strand upon binding to its recognized specific structure, thereby creating a free 3'-hydroxyl group on the terminal nucleotide preceding the nick site that can be extended by a 5'-3'-exonuclease deficient strand displacement polymerase. In a preferred embodiment of the methods disclosed herein, the top strand phosphodiester bond cleavage rate of the "nicking agent" approaches 100%, while the cleavage rate of the bottom strand phosphodiester bond approaches 0%. Nicking agents useful in methods described herein, can either be enzymes, i.e. self-regenerating catalysts turning over multiple substrate molecules, or non-regenerating catalysts turning over just a single substrate molecule at an equimolar ratio.

A nicking enzyme binds double-stranded DNA and cleaves one strand of a double-stranded duplex. In the methods of the invention, the nicking enzyme cleaves the top stand (the strand comprising the 5'-3' sequence of the nicking agent recognition site). The nicking enzyme may cleave either upstream or downstream of the binding site or nicking enzyme recognition site. In a particular embodiment of the invention disclosed herein, the nicking enzyme cleaves the top strand only and 3' downstream of the recognition site. In exemplary embodiments, the reaction comprises the use of a nicking enzyme that cleaves or nicks downstream of the binding site such that the product sequence does not contain the nicking site. Using an enzyme that cleaves downstream of the binding site allows the polymerase to more easily extend without having to displace the nicking enzyme. Ideally, the nicking enzyme is functional under the same reaction conditions as the polymerase. Exemplary nicking enzymes include, but are not limited to, N.Bst9I, N.BstSEI, Nb.BbvCI(NEB), Nb.Bpu10I(Fermantas), Nb.BsmI(NEB), Nb.BsrDI(NEB), Nb.BtsI(NEB), Nt.AlwI(NEB), Nt.BbvCI(NEB), Nt.Bpu10I(Fermentas), Nt.BsmAI, Nt.BspD6I, Nt.BspQI(NEB), Nt.BstNBI(NEB), and Nt.CviPII(NEB). Sequences of nicking enzyme recognition sites are provided at Table 1.

TABLE 1

Nicking enzyme recognition sequences

| Enzyme | Recognition sequence |
|---|---|
| N.Bst9I | 5'-GAGTCNNNNN↓NN-3' (SEQ ID NO: 15508)<br>    \|\|\|\|\|\|\|\|\|\| \|\|<br>3'-CTCAGNNNNN•NN-5' (SEQ ID NO: 15509) |
| N.BstSEI | 5'-GAGTNCNNNN↓NN-3' (SEQ ID NO: 15510)<br>    \|\|\|\|\|\|\|\|\|\| \|\|<br>3'-CTCAGNNNNN•NN-5' (SEQ ID NO: 15509) |
| Nb.BbvCI(NEB) | 5'-CCTCA•GC-3'<br>    \|\|\|\|\| \|\|<br>3'-GGAGT↑CG-5' |
| Nb.Bpu10I(Fermantas) | 5'-CCTNA•GC-3'<br>    \|\|\|\|\| \|\|<br>3'-GGANT↑CG-5' |
| Nb.BsmI(NEB) | 5'-GAATG•CN-3'<br>    \|\|\|\|\| \|\|<br>3'-CTTAC↑GN-5' |
| Nb.BsrDI(NEB) | 5'-GCAATG•NN-3'<br>    \|\|\|\|\|\| \|\|<br>3'-CGTTAC↑NN-5' |
| Nb.BtsI(NEB) | 5'-GCAGTG•NN-3'<br>    \|\|\|\|\|\| \|\|<br>3'-CGTCAC↑NN-5' |
| Nt.AlwI(NEB) | 5'-GGATCNNNN↓N-3' (SEQ ID NO: 15511)<br>    \|\|\|\|\|\|\|\|\|\| \|<br>3'-CCTAGNNNN•N-5' (SEQ ID NO: 15512) |
| Nt.BbvCI(NEB) | 5'-CC↓TCAGC-3'<br>    \|\| \|\|\|\|\|<br>3'-GG•AGTCG-5' |
| Nt.Bpu10I(Fermantas) | 5'-CC↓TNAGC-3'<br>    \|\| \|\|\|\|\|<br>3'-GG•ANTCG-5' |
| Nt.BsmAI | 5'-GTCTCN↓N-3'<br>    \|\|\|\|\|\| \|<br>3'-CAGAGN•N-5' |
| Nt.BspD6I | 5'-GAGTCNNNN↓N-3' (SEQ ID NO: 15513)<br>    \|\|\|\|\|\|\|\|\|\| \|<br>3'-CTCAGNNNN•N-5' (SEQ ID NO: 15514) |
| Nt.BspQI(NEB) | 5'-GCTCTTCN↓-3'<br>    \|\|\|\|\|\|\|\|<br>3'-CGAGAAGN -5' |
| Nt.BstNBI(NEB) | 5'-GAGTCNNNN↓N-3' (SEQ ID NO: 15513)<br>    \|\|\|\|\|\|\|\|\|\| \|<br>3'-CTCAGNNNN•N-5' (SEQ ID NO: 15514) |
| Nt.CviPII(NEB) | 5'-↓CCD-3'<br>    \|\|\|<br>3'- GGH-5' |

Nicking enzymes also include engineered nicking enzymes created by modifying the cleavage activity of restriction endonucleases (NEB expressions July 2006, vol 1.2). when restriction endonucleases bind to their recognition sequences in DNA, two catalytic sites within each enzyme for hydrolyzing each strand drive two independent hydrolytic reactions which proceed in parallel. Altered restriction enzymes can be engineered that hydrolyze only one strand of the duplex, to produce DNA molecules that are "nicked" (3'-hydroxyl, 5'-phosphate), rather than cleaved. Nicking enzymes may also include modified CRISPR/Cas proteins, Transcription activator-like effector nucleases (TALENs), and Zinc-finger nucleases having nickase activity.

A nicking amplification reaction typically comprises nucleotides, such as, for example, dideoxyribonucleoside triphosphates (dNTPs). The reaction may also be carried out in the presence of dNTPs that comprise a detectable moiety including but not limited to a radiolabel (e.g., $^{32}$P, $^{33}$P, $^{125}$I, $^{35}$S) an enzyme (e.g., alkaline phosphatase), a fluorescent label (e.g., fluorescein isothiocyanate (FITC)), biotin, avidin, digoxigenin, antigens, haptens, or fluorochromes. The reaction further comprises certain salts and buffers that provide for the activity of the nicking enzyme and polymerase.

Advantageously, the nicking amplification reaction is carried out under substantially isothermal conditions where the temperature of the reaction is more or less constant during the course of the amplification reaction. Because the temperature does not need to be cycled between an upper temperature and a lower temperature, the nicking amplification reaction can be carried out under conditions where it would be difficult to carry out conventional PCR. Typically, the reaction is carried out at about between 35° C. and 90° C. (e.g., about 35, 37, 42, 55, 60, 65, 70, 75, 80, or 85° C.). Advantageously, it is not essential that the temperature be maintained with a great degree of precision. Some variability in temperature is acceptable.

Sets of primers for amplification reactions are selected having $\Delta\Delta G$'s≤−15, −16, 17, −18, −19, −20, −25, −30 kcal/mole or more. The performance characteristics of amplification reactions may be altered by increasing the concentration of one or more oligonucleotides (e.g., one or more primers and/or probes) and/or their ratios. High concentrations of primers also favor primer-dimer formation. In various embodiments, concentration of a primers is 100, 200, 300, 400, 500, 600, 700, 800, 900, 1000 nM or more. Melt temperature (Tm) and reaction rate modifiers may also be used to lower the melting temperature of the oligonucleotides, such as (but not limited to) ethylene glycol and glycerol. In addition, DNA polymerase reaction rate modifiers (such as dNTP and magnesium concentration) may be used to alter the reaction rate. In particular embodiments, the 5' tail sequences of the forward and reverse primers have the same nucleic acid sequence.

The invention also provides a method of designing a nicking agent-dependent isothermal strand-displacement amplification assay without experimental screening of a multitude of combinations of candidate forward primers and/or candidate reverse primers. A 35 to 70 bp long region within the target sequence is identified having a 12 to 20 bp sequence in the central portion with a Tm≥the assay temperature (e.g., ~55° C.). Adjacent sequences 12 bp to 20 bp long immediately downstream and upstream of the 15 to 20 bp long central region are identified, according to the above criteria. The Tm of the chosen double stranded downstream and upstream adjacent sequences deviate from each other by less than ±3° C. A target-specific pair of forward and reverse primers are created by attaching a 5'-tail region for a stable dimer-forming primer to the 5'-terminus of the 12-20 base upstream adjacent sequence and to the 5'-terminus of the complementary strand of the 12-20 base downstream adjacent sequence. When combining the forward primer, reverse primer, and a probe, the primer driving the synthesis of the strand complementary to the probe is in excess over the other primer at a molar ratio of about 1.1:1 to 10:1. The combined concentration of a primer in the assay is no higher than 1000 nM. The assay design method can also be used to convert a pre-validated PCR assay for an amplicon ≤70 bp to an nicking agent-dependent isothermal strand-displacement amplification assay.

Target Nucleic Acid Molecules

Methods and compositions of the invention are useful for the amplification and/or identification of a target nucleic acid molecule in a test sample. The target sequences is amplified from virtually any samples that comprises a target nucleic acid molecule, including but not limited to samples comprising fungi, spores, viruses, or cells (e.g., prokaryotes, eukaryotes). In specific embodiments, compositions and methods of the invention detect *Clavibacter michiganensis* subsp. *michiganensis, Clavibacter michiganensis* subsp. *sepedonicus, Pseudomonas syringae* pv Tomato, *Xanthomonas campestris* pv *Vesicatoria, Alternaria* spp, *Cladosporium* spp, *Fusarium oxysporum, Verticilium dahlia, Pseudomonas currugata, Erwina carotovora,* and *Ralstonia solanacearum*. Exemplary test samples include body fluids (e.g. blood, serum, plasma, amniotic fluid, sputum, urine, cerebrospinal fluid, lymph, tear fluid, feces, or gastric fluid), tissue extracts, culture media (e.g., a liquid in which a cell, such as a pathogen cell, has been grown), environmental samples, agricultural products or other foodstuffs, and their extracts, and DNA identification tags. If desired, the sample is purified prior to inclusion in a nicking amplification reaction using any standard method typically used for isolating a nucleic acid molecule from a biological sample.

In one embodiment, primers amplify a target nucleic acid of a pathogen to detect the presence of a pathogen in a sample. Exemplary pathogens include fungi, bacteria, viruses and yeast. Such pathogens may be detected by identifying a nucleic acid molecule encoding a pathogen protein, such as a toxin, in a test sample. Exemplary toxins include, but are not limited to aflatoxin, cholera toxin, diphtheria toxin, *Salmonella* toxin, Shiga toxin, *Clostridium botulinum* toxin, endotoxin, and mycotoxin. For environmental applications, test samples may include water, liquid extracts of air filters, soil samples, building materials (e.g., drywall, ceiling tiles, wall board, fabrics, wall paper, and floor coverings), environmental swabs, or any other sample. In one embodiment, primer oligonucleotidess amplify a target nucleic acid of a plant used as an internal control in molecular breeding experiments geared towards improving, for example, the plant's resistance to drought, the plant's resistance to herbicides, or to predation by harmful insects.

Target nucleic acid molecules include double-stranded and single-stranded nucleic acid molecules (e.g., DNA, and other nucleobase polymers known in the art capable of hybridizing with a nucleic acid molecule described herein). DNA molecules suitable for detection with a detectable oligonucleotide probe or primer of the invention include, but are not limited to, double stranded DNA (e.g., genomic DNA, plasmid DNA, mitochondrial DNA, viral DNA, and synthetic double stranded DNA). Single-stranded DNA target nucleic acid molecules include, for example, viral DNA, cDNA, and synthetic single-stranded DNA, or other types of DNA known in the art.

In general, a target sequence for detection is between 10 and 100 nucleotides in length (e.g., 10, 15, 20, 25, 30, 35, 40, 45, 50, 60, 70, 80, 90, 100 nucleotides. The GC content of the target nucleic acid molecule is selected to be less than about 45, 50, 55, or 60%. Desirably, the target sequence and nicking enzymes are selected such that the target sequence does not contain nicking sites for any nicking enzymes that will be included in the reaction mix.

Applications

Figure 4:
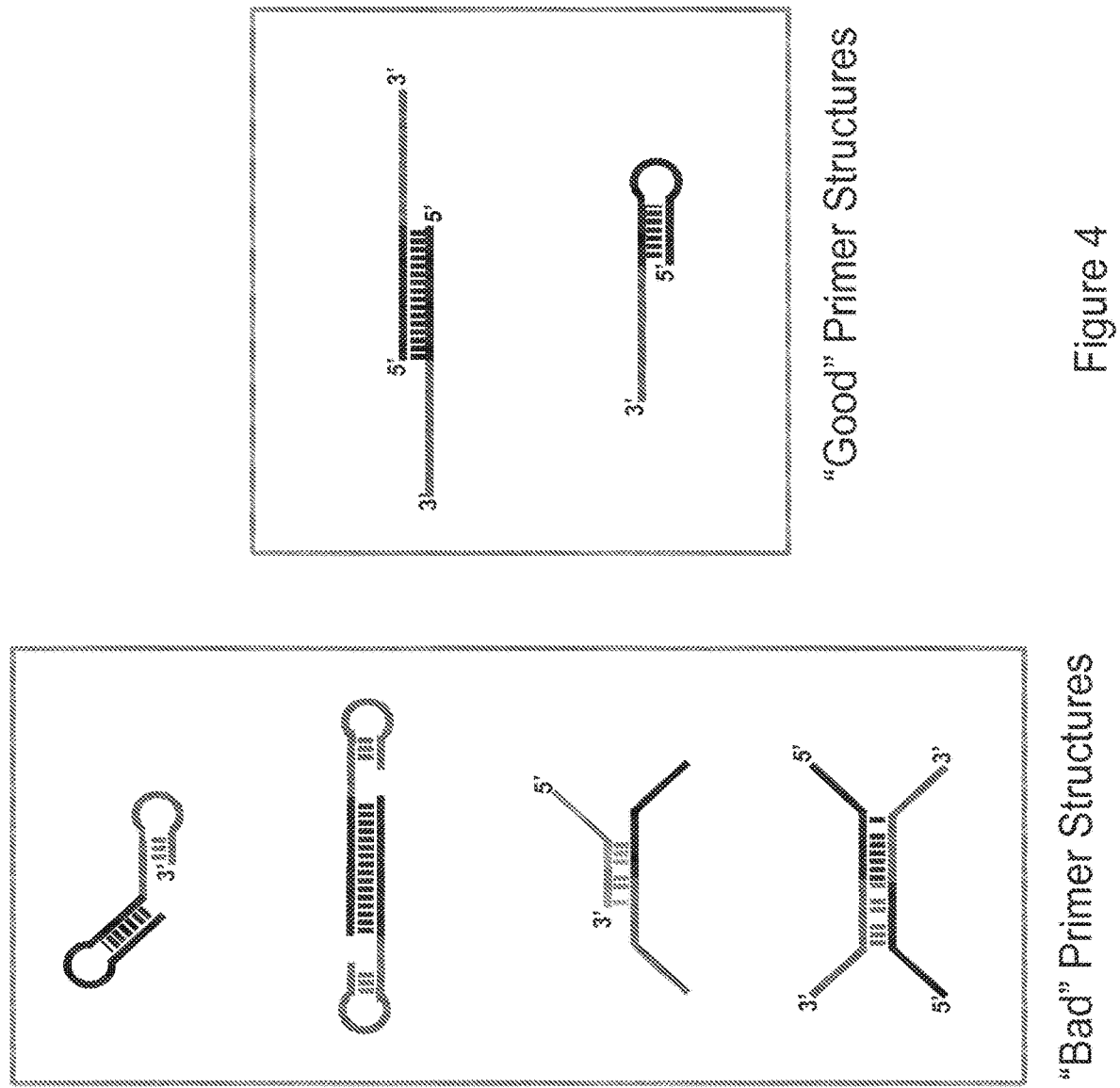
FIG. 4 shows desirable (right) and undesirable (left) primer structures. The primers of the invention may adopt a structure favorable to the amplification reaction, including primer-dimers and/or a hairpin, due to the presence of self-complementary sequences. Without being bound to theory, primer dimers are more stable and form when primers are present at high concentration in the reaction (e.g., at the start of the reaction) and hairpins form when primer concentration is reduced (e.g., during the course of the reaction).
Figure 5:
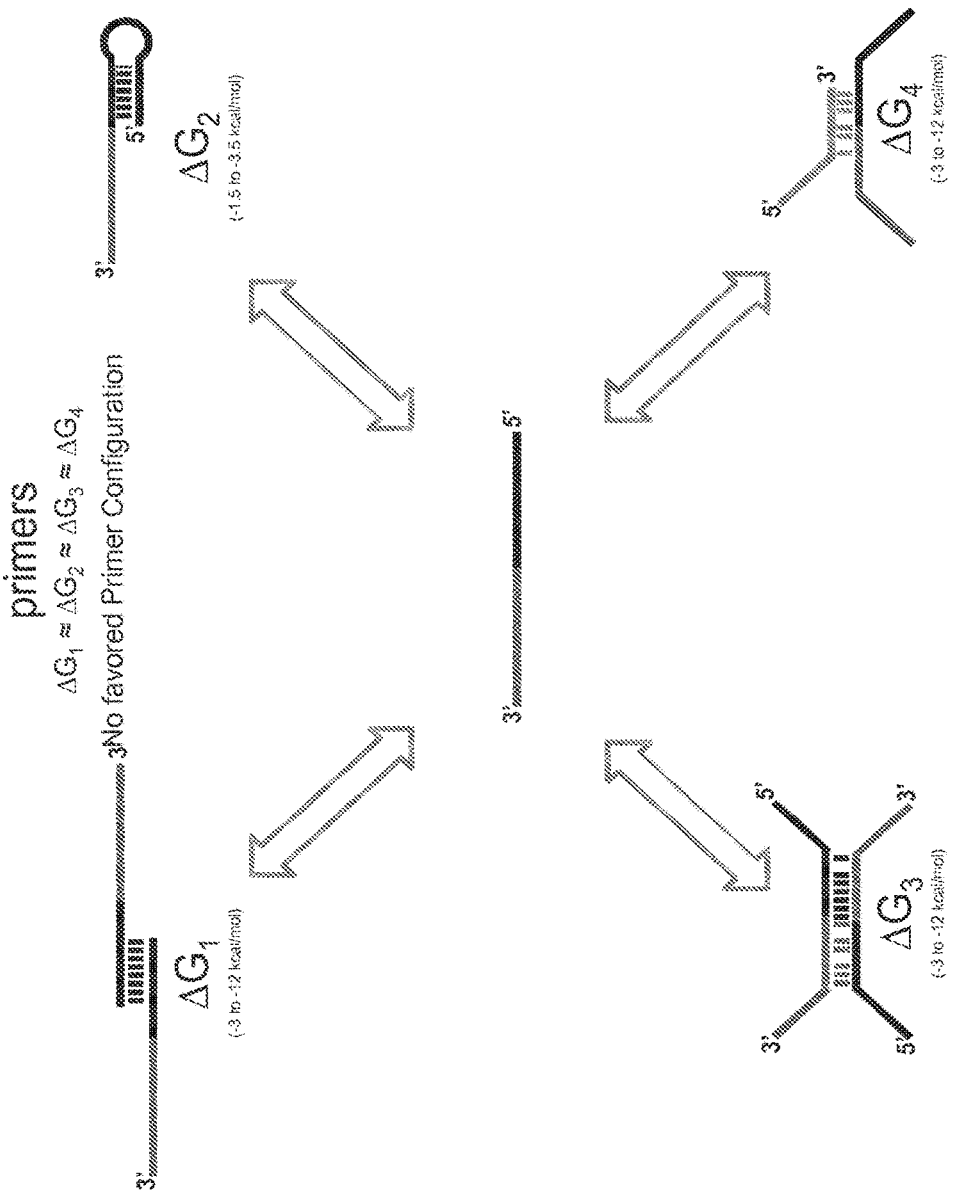
FIG. 5 depicts an undesirable primer configuration where a dynamic equilibrium exists between configurations of non-optimal primers. Where the ΔG's corresponding to the formation of each structure are about the same (i.e., $\Delta G_1 \approx \Delta G_2 \approx \Delta G_3 \approx \Delta G_4$), there is no favored primer configuration or structure. When a primer exists in such multiple configurations, it is not optimally configured to promote the nucleic acid amplification reaction.
Figure 6:
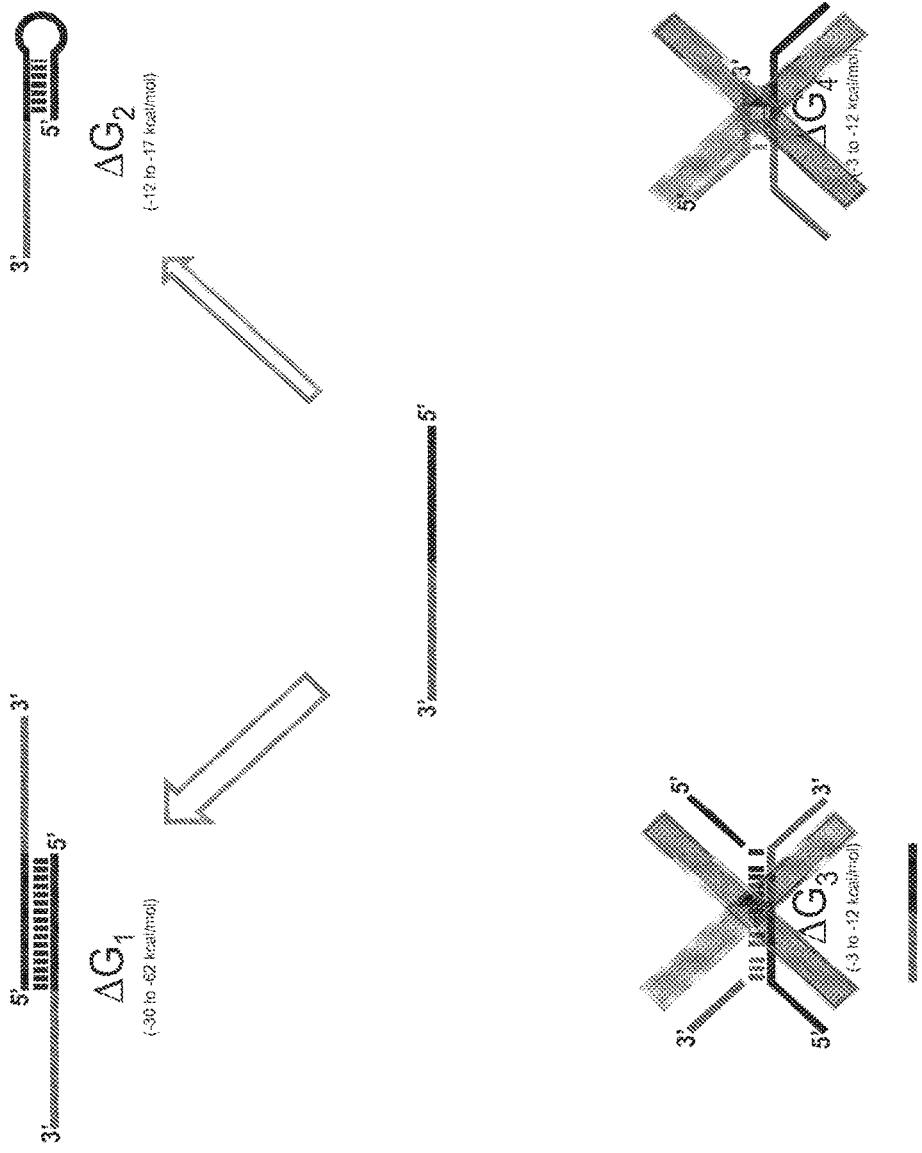
FIG. 6 shows that an optimal primer is one in which the dimer configuration is highly favored (i.e., $\Delta G' >> \Delta G_2$), especially over the next favored configuration (e.g., where the primer interacts with itself intramolecularly). This configuration is in contrast to FIG. 5, where a dynamic equilibrium exists between configurations. Primers can be designed to have stable configurations and structures favorable for nucleic acid amplification reactions, while reducing or eliminating the formation of undesirable primer configurations and structures. For primers having a 5' tail dimerization region, the 5' tail sequence is selected to favor and be more stable than other structures ($\Delta G_1 \leq -30$ to $-62$ kcal/mol). For primers in nicking amplification reactions, the 5' tail sequence is substantially self-complementary and symmetrically inverted. Such primers may have the potential to form intramolecular interactions (e.g., a hair-pin loop). However, such configurations are minimized when the symmetrically inverted sequences are fully self-complementary, as indicated by the stability of the primer-dimer over the hair-pin loop structure (a very low $\Delta G_1$ in comparison to $\Delta G_2$). Thus, when the primer is at a high enough concentration, the hair-pin is not effectively formed.
Figure 7:
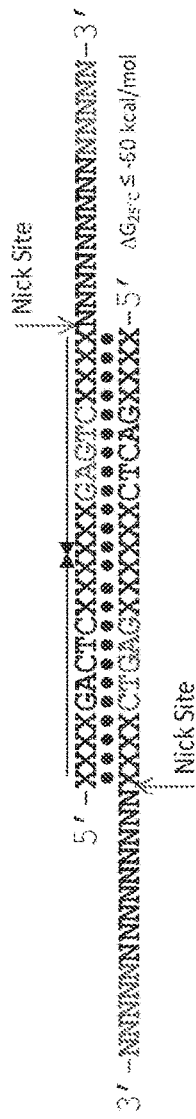
FIG. 7 depicts sequences of stable primer-dimer structures of primers useful in nicking amplification reactions.
Figure 9:
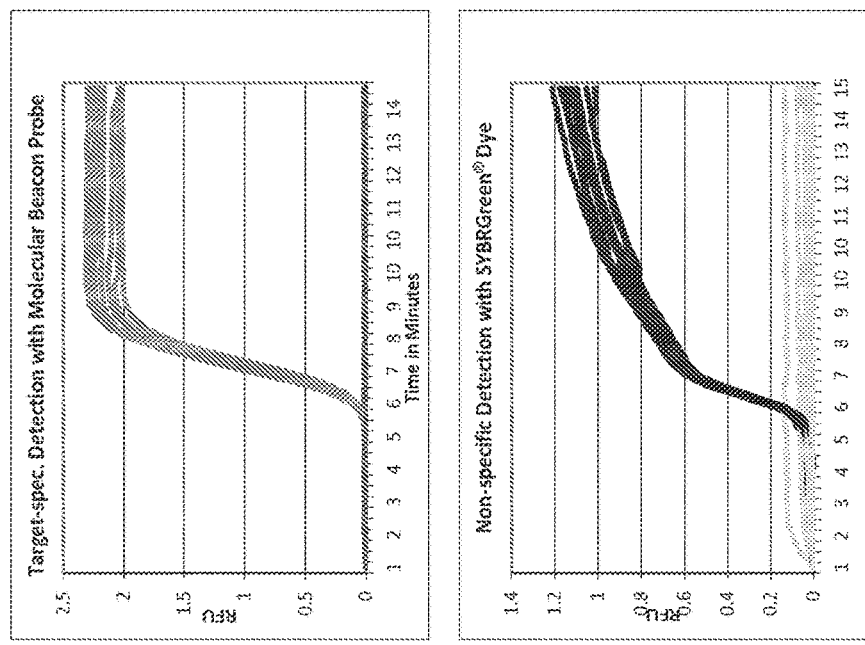
FIG. 9 are graphs showing target specific nucleic acid amplification using primers of the invention having 5' tail and 3' recognition regions as detected by dual channel detection of DNA amplification. Target-specific products are detected by a molecular beacon probe (top panel). Non-specific nucleic acid amplification is detected by SYBR-Green. As seen in both graphs, exponential amplification begins at around 6 minutes, indicating that amplification is target specific. Control reactions having no input did not produce substantial background.
Figure 10:
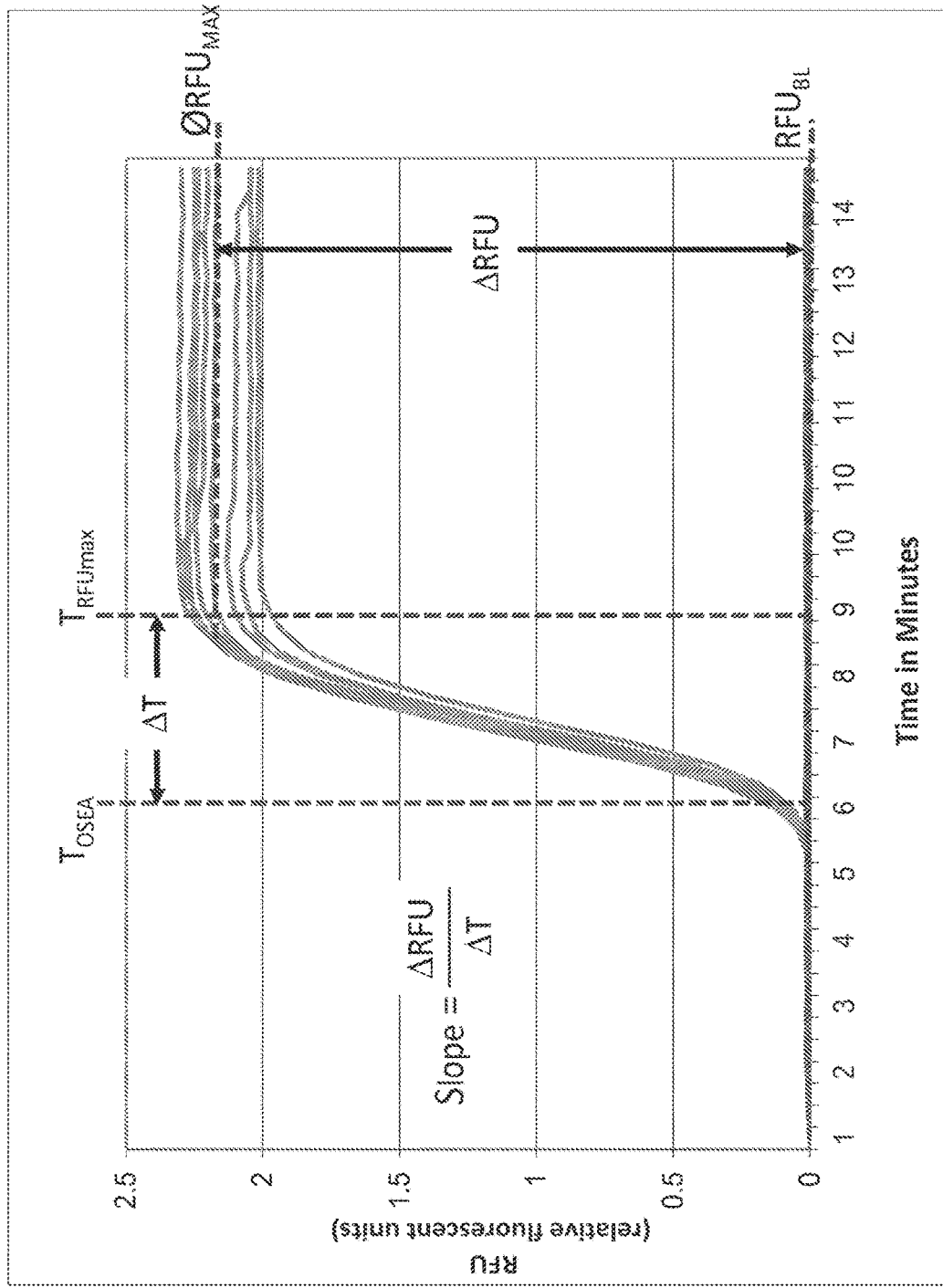
FIG. 10 is a graph showing that nucleic acid amplification using primers of the invention having 5' tail and 3' recognition regions have characteristics useful for rapid detection of target nucleic acids. Such reactions are characterized by a high signal-to-noise ratio ($[RFU_{MAX}-RFU_{BL}]$), steep slope (high value of $[RFU_{MAX}-RFU_{BL}]/[T_{OSEA}-T_{RFUmax}]$), early onset of the exponential amplification phase ($T_{OSEA}<10$ min) and low signal variance between replicated assay reactions of the same sample.

Target nucleic acid amplification using primers of the invention have characteristics useful for rapid detection of target nucleic acids (FIG. 10). Such reactions are characterized by a high signal-to-noise ratio ([$RFU_{MAX}$−$RFU_{BL}$]), steep slope (high value of [$RFU_{MAX}$−$RFU_{BL}$]/[$T_{OSEA}$−$T_{RFUmax}$]), early onset of the exponential amplification phase ($T_{OSEA}$<10 min) and low signal variance between replicated assay reactions of the same sample. In certain embodiments, $T_{OSEA}$−$T_{RFUmax}$≈3 min.

The present invention provides for the real-time monitoring of the isothermic amplification reaction. Compositions and methods of the invention are useful in human diagnostics, where rapid detection is desired (e.g., detectable amplification in under 20, 15, 10, 9, 8, 7, 6, 5 min. or less). In particular embodiments, the invention provides for the use of nicking amplification reaction assays in human diagnostics in clinical settings. In other embodiments, the invention provides for the use of nicking amplification reaction assays in diagnostic field work, where access to thermocycling equipment is unavailable or would be prohibitively expensive. In still other embodiments, the invention provides for the use of nicking amplification reaction assays in an academic setting where rapid nucleic acid amplification and detection are desired.

Detectable Oligonucleotide Probes

The present invention provides for the detection of target nucleic acid molecules or amplicons thereof in a nicking amplification reaction using non-amplifiable detectable polynucleotide probes comprising at least one polymerase-arresting molecule (e.g., nucleotide modification or other moiety that renders the oligonucleotide capable of binding a target nucleic acid molecule, but incapable of supporting polymerase extension utilizing the detectable oligonucleotide probe as a target). Without wishing to be bound by theory, the presence of one or more moieties which does not allow polymerase progression likely causes polymerase arrest in non-nucleic acid backbone additions to the oligonucleotide or through stalling of a replicative polymerase (i.e. C3-spacer, damaged DNA bases, other spacer moiety, O-2-Me bases). These constructs thus prevent or reduce illegitimate amplification of the probe during the course of a nicking amplification reaction. This distinguishes them from conventional detection probes, which must be added at the end of the nicking amplification reaction to prevent their amplification.

Conventional detection probes have proven impractical for detecting a nicking amplification reaction in real time. If conventional detection probes are incorporated into the nicking amplification reaction, these conventional detection probes are amplified concurrently with the target. The amplification of these detection molecules masks the detection of legitimate target amplicons due to the number of starting molecules of the detection probe at the start of the reaction.

The invention provides non-amplifiable detectable polynucleotide probe that comprise least one polymerase-arresting molecule. A polymerase-arresting molecule of the invention includes, but is not limited to, a nucleotide modification or other moiety that blocks extension by replicative DNA polymerases, thereby preventing the amplification of detection molecules; but can allow proper hybridization or nucleotide spacing to the target molecule or amplified copies of the target molecule. In one embodiment, a detectable oligonucleotide probe of the invention comprises a 3 carbon spacer (C3-spacer) that prevents or reduces the illegitimate amplification of a detection molecule.

In one embodiment, a detectable oligonucleotide probe comprises one or more modified nucleotide bases having enhanced binding affinity to a complementary nucleotide. Examples of modified bases include, but are not limited to 2' Fluoro amidites, and 2'OMe RNA amidites (also functioning as a polymerase arresting molecule). Detectable oligonucleotide probes of the invention can be synthesized with different colored fluorophores and may be designed to hybridize with virtually any target sequence. In view of their remarkable specificity, a non-amplifiable detectable polynucleotide probe of the invention is used to detect a single target nucleic acid molecule in a sample, or is used in combination with detectable oligonucleotide probes each of which binds a different target nucleic acid molecule. Accordingly, the non-amplifiable detectable polynucleotide probes of the invention may be used to detect one or more target nucleic acid molecules in the same reaction, allowing these targets to be detected simultaneously. The present invention encompasses the use of such fluorophores in conjunction with the detectable oligonucleotide probes described herein.

Use of Non-Amplifiable Detectable Polynucleotide Probes

Non-amplifiable detectable polynucleotide probe are useful in methods for amplifying and detecting a target nucleic acid molecule in a nicking amplification reaction. The method involves contacting a target nucleic acid molecule under substantially isothermal conditions with a polymerase, two primers, each of which specifically binds to a complementary sequence on the target nucleotide molecule, a nicking enzyme, and the detectable oligonucleotide probe in the presence of a suitable buffer and dNTPs, generating amplicons comprising at least a portion of said target nucleic acid molecule; and detecting the target nucleic acid molecule present in the reaction by detecting the oligonucleotide probe that hybridizes to the target nucleic acid molecule in real time during the reaction based on fluorescent intensity from the probe molecules in the reaction. Advantageously, such methods are useful for monitoring nicking amplification reactions in real time.

In general, non-amplifiable detectable polynucleotide probes of the invention are included in a nicking amplification reaction that comprises (1) a target nucleic acid molecule; (2) two primers comprising some number of oligonucleotides that are complementary to the target nucleic acid molecule and a site that can be cleaved by a nicking enzyme; (3) dNTPs; (4) a strand displacing polymerase; and (5) a nicking enzyme. Accordingly, the invention provides a method of using these components to detect a target nucleic acid molecule.

Implementation in Hardware and/or Software

The methods described herein can be implemented on general-purpose or specially programmed hardware or software. For example, the methods can be implemented by a computer readable medium. Accordingly, the present invention also provides a software and/or a computer program product configured to perform the algorithms and/or methods according to any embodiment of the present invention. It is well-known to a skilled person in the art how to configure software which can perform the algorithms and/or methods provided in the present invention. The computer-readable medium can be non-transitory and/or tangible. For example, the computer readable medium can be volatile memory (e.g., random access memory and the like) or non-volatile memory (e.g., read-only memory, hard disks, floppy discs, magnetic tape, optical discs, paper table, punch cards, and the like). The computer executable instructions may be written in a suitable computer language or combination of several languages. Basic computational biology methods are described in, for example Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., $2^{nd}$ ed., 2001).

The present invention may also make use of various computer program products and software for a variety of purposes, such as probe design, management of data, analysis, and instrument operation. (See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.) Additionally, the present invention may have preferred embodiments that include methods for providing genetic information over networks such as the Internet as shown in U.S. Ser. Nos. 10/197,621, 10/063,559 (US Pub No 20020183936), Ser. Nos. 10/065,856, 10/065,868, 10/328,818, 10/328,872, 10/423,403, and 60/482,389.

Kits

The invention also provides kits for the amplification of a target nucleic acid molecule. Such kits are useful for the amplification and detection of a target nucleic acid in a biological sample obtained from a subject. Kits of the present invention may comprise, for example, one or more polymerases, forward and reverse primers, and one or more nicking enzymes, as described herein. Where one target is to be amplified, one or two nicking enzymes may be included in the kit. Where multiple target sequences are to be amplified, and the primers designed for those target sequences comprise the nicking enzyme sites for the same nicking enzyme, then one or two nicking enzymes may be included. Where the primers are recognized by different nicking enzymes, more nicking enzymes may be included in the kit, such as, for example, 3 or more.

In one aspect, the invention provides a kit for nucleic acid amplification comprising a DNA polymerase; a primary primer, a secondary primer, a nicking enzyme with specificity to a nicking enzyme binding site within the primers, and deoxynucleotide triphosphates (dNTP's) (e.g., in a buffered solution containing components sufficient for amplification. In various embodiments, the primary primer and secondary primer, each have a 3'-end specific recognition region sequence complementary or substantially complementary to the target sequence, where the end specific recognition region comprises one or more 2' modified nucleotides; a 5'-end tail region containing a nicking enzyme binding site upstream of the 3'-end specific recognition region sequences that is able to dimerize with itself (e.g., self-complementary). In particular embodiments, one or more primers are in a primer-dimer configuration (e.g., produced by heating about Tm and slow cooling).

The kits of the present invention may also comprise one or more of the components in any number of separate containers, packets, tubes (e.g., <0.2 ml, 0.2 ml, 0.6 ml, 1.5 ml, 5.0 ml, >5.0 ml), vials, microtiter plates (e.g., <96-well, 96-well, 384-well, 1536-well, >1536-well), ArrayTape, and the like, or the components may be combined in various combinations in such containers. In various embodiments, the kit further comprises a pair of primers capable of binding to and amplifying a reference sequence. In particular embodiments, the kit comprises one or more primers in a primer-dimer configuration (e.g., produced by heating about Tm and slow cooling). In yet other embodiments, the kit comprises a sterile container which contains the primers; such containers can be boxes, ampules, bottles, vials, tubes, bags, pouches, blister-packs, or other suitable container form known in the art. Such containers can be made of plastic, glass, laminated paper, metal foil, or other materials suitable for holding nucleic acids.

The components of the kit may, for example, be present in one or more containers, for example, all of the components may be in one container, or, for example, the enzymes may be in a separate container from the primers. The components may, for example, be dried (e.g., powder) or in a stable buffer (e.g., chemically stabilized, thermally stabilized). Dry components may, for example, be prepared by lyophilization, vacuum and centrifugal assisted drying and/or ambient drying. In various embodiments, the polymerase and nicking enzymes are in lyophilized form in a single container, and the primers are either lyophilized, freeze dried, or in buffer, in a different container. In some embodiments, the polymerase, nicking enzymes, and the primers are, in lyophilized form, in a single container. In other embodiments, the polymerase and the nicking enzyme may be separated into different containers.

Kits may further comprise, for example, dNTPs used in the reaction, or modified nucleotides, cuvettes or other containers used for the reaction, or a vial of water or buffer for re-hydrating lyophilized components. The buffer used may, for example, be appropriate for both polymerase and nicking enzyme activity.

The kits of the present invention may also comprise instructions for performing one or more methods described herein and/or a description of one or more compositions or reagents described herein. Instructions and/or descriptions may be in printed form and may be included in a kit insert. A kit also may include a written description of an Internet location that provides such instructions or descriptions.

Kits may further comprise reagents used for detection methods (e.g., real-time or endpoint), such as, for example, hybridization probes or DNA binding dyes. Kits may further comprise reagents used for detection methods, such as, for example, reagents used for FRET, lateral flow devices, dipsticks, fluorescent dye, colloidal gold particles, latex particles, a molecular beacon, or polystyrene beads. Detection components may be incorporated into a lateral flow device. The lateral flow device may be used at a point of care.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

EXAMPLES

Example 1. Design of a System for Isothermal DNA Amplification of Soy Lectin by Determining Stability of Primer Target Binding A successful working isothermal DNA amplification assay for detection of Soy Lectin was created using no more than the design principles in accordance with the invention and without the aid of experimental testing of the primers (FIG. 12).

An assay target sequence in the Soy Lectin gene was selected based on the absence of single nucleotide polymorphisms (SNP's) in a 30 to 60 bp sequence window:

```
                                        (SEQ ID NO: 15316)
5'-ccaaggttctcattacctatgatgcctccaccagcctcttggttg
cttctttggtctaccottcacagagaa-3'
```

Shown in bold are the sequence regions selected for design of the forward and reverse primers, respectively.

For selecting the target binding sequence of the Forward primer (5'-ATTACCTATGATGCC-3' (SEQ ID NO: 15317)), the stability of Forward primer binding to target was compared to the stability of Forward primer self-dimerization, as follows:

$\Delta G_{25°\,C.}$ of Forward Primer-Target Hybrid (PrTH)=−25.99 kcal/mole;

$\Delta G_{25°\,C.}$ of Primer-Target binding region self dimer (PrTBRHD)=−3.14 kcal/mole;

$\Delta\Delta G_{25°\,C.} = \Delta G_{PTH} - \Delta G_{PTBRHD}$ =−22.85 kcal/mole.

A low $\Delta\Delta G$ (≤about −16 kcal/mole) indicates that the Forward primer is capable of annealing to and initiating synthesis of the complementary strand of the target nucleic acid molecule.

For selecting the target binding sequence of the Reverse primer (5'-ACCAAAGAAGCAAC-3' (SEQ ID NO: 15318)), the stability of Reverse primer binding to target was compared to the stability of Reverse primer self-dimerization, as follows:

The stability ($\Delta G$) and relative stability to nearest ($\Delta\Delta G$) of the target binding region of the Reverse primer 5'-ACCAAAGAAGCAAC-3' (SEQ ID NO: 15318) was determined as follows:

$\Delta G_{25°\,C.}$ of rev Primer-Target Hybrid (PrTH)=−25.35 kcal/mole;

$\Delta G_{25°\,C.}$ of Primer-Target binding region self dimer (PrTBRHD)=−3.14 kcal/mole;

$\Delta\Delta G_{25°\,C.} = \Delta G_{PTH} - \Delta G_{PTBRHD}$ =−22.21 kcal/mole.

A low $\Delta\Delta G$ (≤about −16 kcal/mole) indicates that the Reverse primer is capable of annealing to and initiating synthesis of the complementary strand of the target nucleic acid molecule.

Nicking amplification reactions (50 μl) contained 0.3 mM dNTPs, 0.38 U/ml Bst 2.0 WarmStart DNA Polymerase (New England Biolabs), 0.15 units Nt.BstNBI (New England Biolabs), 250 nM forward primer, 250 nM reverse primer, 200 nM molecular beacon probe labeled at the 5'-terminus with CalRed (BioSearch) and at the 3'-terminus with BHQ2 (BioSearch), and *Glycine max* genomic DNA (10,000 copies). Primer and probe sequences (synthesized by BioSearch Inc., Novato, Calif.) were as follows:

```
Forward primer ("m" = 2'-methoxy nucleotide)
                                        (SEQ ID NO: 15319)
5'-ACGCGACTCGTCGACGAGTCGCGTATTACCTATGAmUmGmCmC-3'

Reverse primer ("m" = 2'-methoxy nucleotide)
                                        (SEQ ID NO: 15320)
5'-ACGCGACTCGTCGACGAGTCGCGTACCAAAGAAmGmCmAmAmC-3'

Molecular beacon probe ("I" stands for universal
inosine nucleotide)
                                        (SEQ ID NO: 15321)
5'-CalRed₆₁₀-CGCGCTCCACCAICCTCTTGCGCG-BHQ2-3'
```

Reactions were incubated at 56° C. for approximately 10 minutes on an IQ5 thermo cycler (BioRad). Fluorescent signal was recorded on ROX channel (excitation: 575 nm; emission: 602 nm). Reactions containing soy gDNA (n=3) generated sigmoid-shaped curves (FIG. 13). In contrast control reactions containing no target DNA (n=3) generated no signal. Time to onset of exponential amplification was about 3 minutes and time to onset of maximum relative fluorescence units was about 6 minutes. The Ø slope of the exponential amplification phase of the reactions was determined to be 660 RFU/min.

Example 2. Design of a System for Isothermal DNA Amplification of *Salmonella enterica* invA by Determining Stability of Primer Target Binding A readily, operational isothermal DNA amplification assay for detection of *Salmonella enterica* invA was created using no more than the design principles in accordance with the invention and without the aid of further experimental testing of the primers.

An assay target sequence in the *Salmonella enterica* invA gene was selected based on the absence of single nucleotide polymorphisms (SNP's) in a 30 to 60 bp sequence window:

```
                                        (SEQ ID NO: 15322)
5'-ATACTCATCTGTTTACCGGGCATACCATCCAGAGAAAA-3'
```

Shown in bold are the sequence regions selected for design of the forward and reverse primers, respectively.

For selecting the target binding sequence of the Forward primers (5'-ATACTCATCTGTTTACC-3' (SEQ ID NO: 15323)), the stability of Forward primer binding to target was compared to the stability of Forward primer self-dimerization, as follows:

$\Delta G_{25°\,C.}$ of fwd Primer-Target Hybrid (PTH)=−26.11 kcal/mole;

$\Delta G_{25°\,C.}$ of Primer-Target binding region self dimer (PT-BRHD)=−1.95 kcal/mole;

$\Delta\Delta G_{25°\,C.} = DG_{PTH} - \Delta G_{PTBRHD}$ =−24.16 kcal/mole

A low $\Delta\Delta G$ (≤about −16 kcal/mole) indicates that the Forward primers are capable of annealing to and initiating synthesis of the complementary strand of the target nucleic acid molecule.

For selecting the target binding sequence of the Reverse primer (5'-TTTTCTCTGGATGG-3' (SEQ ID NO: 15324)), the stability of Reverse primer binding to target was compared to the stability of Reverse primer self-dimerization, as follows:

$\Delta G_{25°\,C.}$ of rev Primer-Target Hybrid (PTH)=−25.28 kcal/mole;

$\Delta G_{25°\,C.}$ of Primer-Target binding region self dimer (PT-BRHD)=−1.57 kcal/mole;

$\Delta\Delta G_{25°\,C.} = \Delta G_{PTH} - \Delta G_{PTBRHD}$ =−23.71 kcal/mole.

A low $\Delta\Delta G$ (≤about −16 kcal/mole) indicates that the Reverse primer is capable of annealing to and initiating synthesis of the complementary strand of the target nucleic acid molecule.

Nucleic Acid Amplification Reactions (25 μl) contained 0.3 mM dNTPs, 0.38 U/ml Bst 2.0 WarmStart DNA Polymerase (New England Biolabs), 0.15 units Nt.BstNBI (New England Biolabs), 200 nM forward primer, 800 nM reverse primer, 300 nM molecular beacon probe labeled at the 5'-terminus with CalRed (BioSearch) and at the 3'-terminus with BHQ2 (BioSearch), and *Salmonella* genomic DNA (10,000 copies). Primer and probe sequences (synthesized by BioSearch Inc., Novato, Calif.) are as follows:

```
Forward primer 1 ("m" = 2'-methoxy nucleotide)
                                          (SEQ ID NO: 15325)
5'-GGCTGACTCCTGCAGGAGTCAGCCATACTCATCTGmUmUmUmAm
CmC-3'

Forward primer 2 ("m" = 2'-methoxy nucleotide)
                                          (SEQ ID NO: 15326)
5'-GGCTGACTCCTGCAGGAGTCAGCCATACTCATCTGTmUmUmAm
CmC-3'

Reverse primer ("m" = 2'-methoxy nucleotide)
                                          (SEQ ID NO: 15327)
5'-GGCTGACTCCTGCAGGAGTCAGCCTTTTCTCTGmGmAmUmGmG-3'

Molecular beacon probe ("I" stands for universal
inosine nucleotide)
                                          (SEQ ID NO: 15328)
5'-CalRed_{610}-ACCTGTTTACCGGGCATACAAACAGGT-BHQ2-3'
```

Reactions were incubated at 56° C. for approximately 10 minutes on an IQ5 thermo cycler (BioRad). Fluorescent signal was recorded on ROX channel (excitation: 575 nm; emission: 602 nm). Reactions containing soy gDNA (n=3) generated sigmoid-shaped curves (FIG. 15). In contrast control reactions containing no target DNA (n=3) generated no signal. Time to onset of exponential amplification was about 3 minutes and time to onset of maximum relative fluorescenc units was about 6 minutes. The Ø slope of the exponential amplification phase of the reactions was determined to be 660 RFU/min.

The results of assay optimization are shown in FIGS. 16A and 16B.

Example 3. Identification of ΔΔG as a Relative Thermodynamic Parameter Correlating with Performance of Candidate Primer/Probe Sets Designed for Isothermal Amplification Assays. Determination of a Threshold Values Predicting Success or Failure of a Primer Oligonucleotide in a Primer/Probe Set Designed in Silico A set of 34 oligonucleotide primers comprising in 5'-3' direction a self-complementary first region (5'-tail with the nicking enzyme recognition sequence) and a target sequence complementary second region were analyzed for a multitude of parameters commonly used in primer design algorithms, such as melting temperature ($T_M$) of the hybrid duplex, % GC content, sequence length and ΔG. All parameters were determined separately for the first and second primer regions, respectively. A subset of 25 primers belonged to verified functional isothermal DNAble® assays. A subset of 9 primers belonged to candidate primer/probe sets that failed to produce a probe-detectable amplification product in assay screening experiments.

A number of two-dimensional matrix plots (FIGS. 17A-17H) were generated using different combinations of design parameters for the X- and Y-axis, respectively, with the intent to identify parameter combinations at which the data points of failing assay primers would cluster separately from the data points of functional assay primers. As demonstrated by the plots at FIGS. 17B-17H, no combination of standard design parameters used in prior art for primer design ($T_M$, ΔG, % GC, sequence length in bases) produced a discernable separation of functional from non-functional primers in a two dimensional plot matrix. The data points of both primer populations widely overlap in these plots, as was expected due to the wide overlapping ranges of standard parameter values among functional and non-functional oligonucleotide primers.

Figure 17:
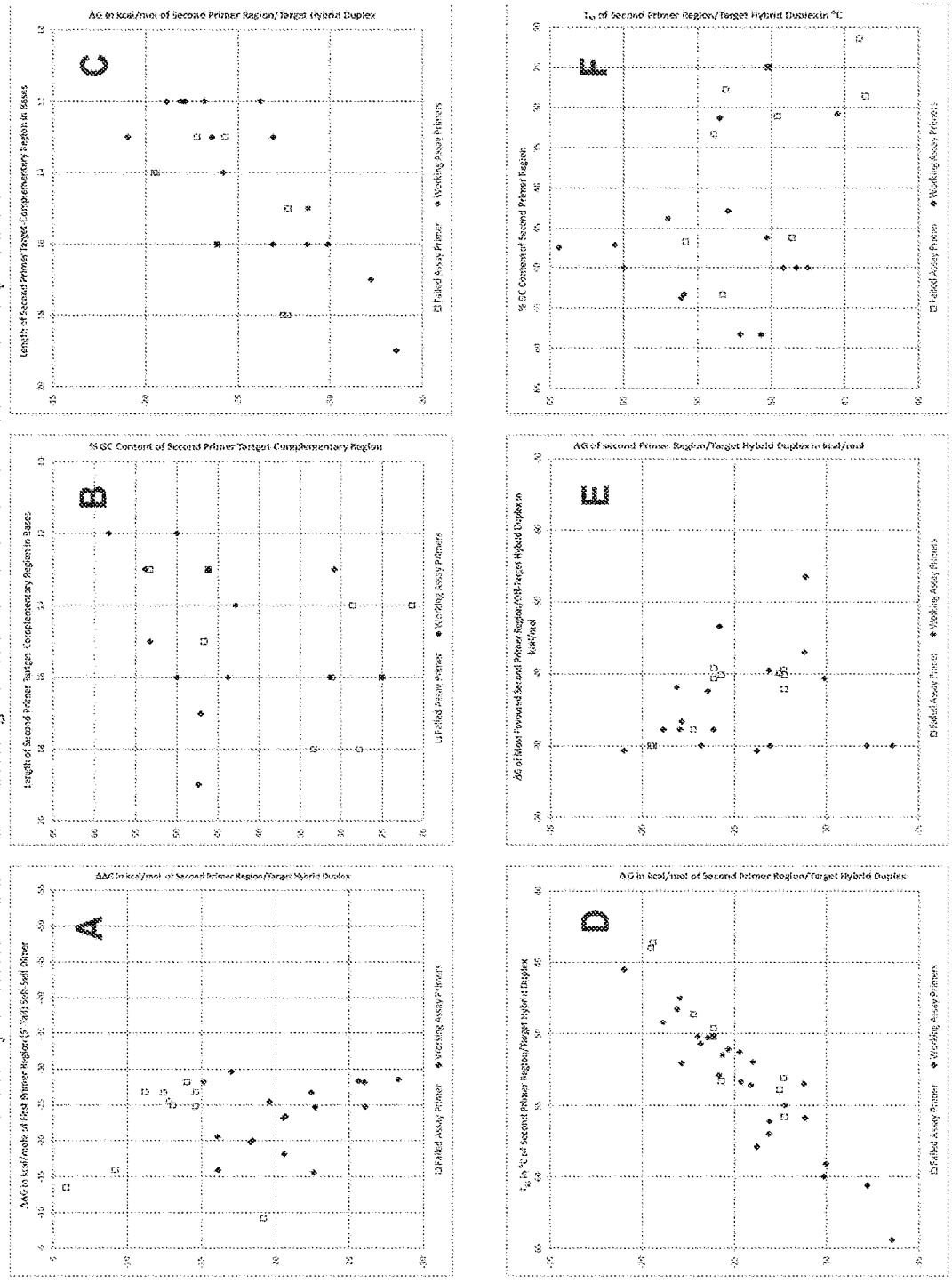
FIGS. 17A-17I shows Primer Structure Parameter ($T_M$, % GC, bp Length, $\Delta G_{25°\,C.}$, $\Delta\Delta G_{25°\,C.}$) Cluster Analysis.
Figure 17:
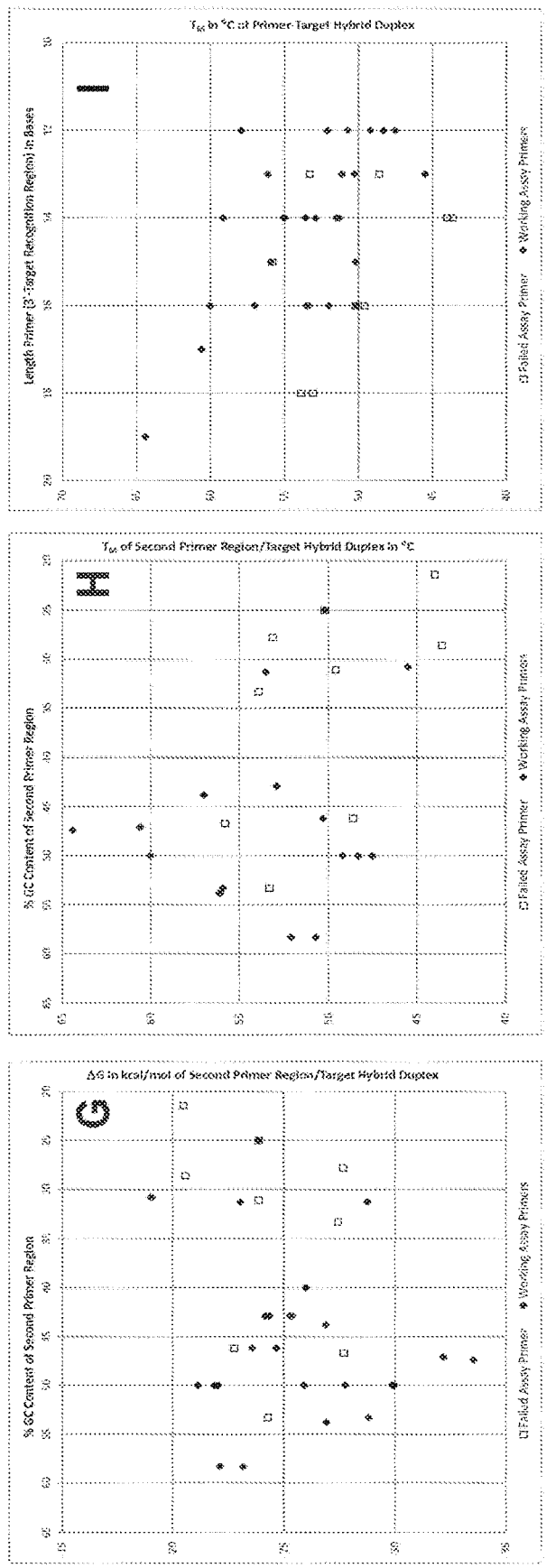

Surprisingly, only the novel relative thermodynamic parameter of ΔΔG as defined by the inventors of this application produced a matrix in which the data points of functional and non-functional primers clustered separately in correlation with the experimental outcome of primer set screening tests. The plot at FIG. 17A shows a matrix in which the X-axis provides the scale for plotting the ΔΔG values of the self-complementary first primer region and the Y-axis provides the scale for plotting the ΔΔG values of the target-complementary second primer region, respectively. All failing assay primers possessed ΔΔG values for either the second region/target duplex (in most cases), or the first region self-complementary duplex (in 1 case) that were less than −15 kcal/mol. Therefore, the ΔΔG value of about −15 kcal/mol turned to be the experimental threshold for this oligonucleotide primer data set that separates functional from non-functional primers.

ΔΔG is a relative parameter that measures the difference, i.e. relative advantage, of thermodynamic favorability of formation of the desired oligonucleotide structure (specific primer/target hybrid and first region self dimer) over the favorability of the formation of a multitude of predicted alternative structures at room temperature and atmospheric pressure in a dynamic equilibrium. Surprisingly, this ΔG advantage (ΔΔG) turned out to be the predictive parameter for assay success when candidate primer oligonucleotides are designed in silico. The use of calculated ΔΔG values as a ranking score and predictor for functional isothermal assays was reduced to praxis in the following examples describing the design and test of isothermal DNAble® assays for the detection of the soy lectin gene and the *Salmonella enterica* invA gene. For the very first time, the screening of candidate primers and probes was performed exclusively in silico using calculated ΔΔG values. In each case, only a single primer/probe set was selected and tested experimentally. Two functional assays were established at first trial without time-consuming and costly screening of a multitude of candidate primer/probe sets.

Other Embodiments

From the foregoing description, it will be apparent that variations and modifications may be made to the invention described herein to adopt it to various usages and conditions. Such embodiments are also within the scope of the following claims.

The recitation of a listing of elements in any definition of a variable herein includes definitions of that variable as any single element or combination (or subcombination) of listed elements. The recitation of an embodiment herein includes that embodiment as any single embodiment or in combination with any other embodiments or portions thereof.

This application may be related to International Patent Application No. PCT/US2013/035750, filed Apr. 9, 2013, which claims priority to and benefit of U.S. Provisional Application No. 61/621,975, filed Apr. 9, 2012, the entire contents of which are incorporated herein by reference.

This application may be related to International Patent Application No. PCT/US2011/047049, filed Aug. 9, 2011, which claims priority to and benefit of U.S. Provisional Application No. 61/373,695, filed Aug. 13, 2010, the entire contents of which are incorporated herein by reference.

All patents and publications mentioned in this specification are herein incorporated by reference to the same extent as if each independent patent and publication was specifically and individually indicated to be incorporated by reference.

SEQUENCE LISTING (15570 sequences)

SEQ ID NO: 1 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccgatcggagtcnnnn

SEQ ID NO: 2 - DNA, 24 bp, Artificial Sequence
  Description of Artificial Sequence: Synthetic oligonucleotide
ggcggactccgatcggagtccgcc

SEQ ID NO: 3 - DNA, 24 bp, Artificial Sequence
  Description of Artificial Sequence: Synthetic oligonucleotide
agcggactccgatcggagtccgct

SEQ ID NO: 4 - DNA, 24 bp, Artificial Sequence
  Description of Artificial Sequence: Synthetic oligonucleotide
gacggactccgatcggagtccgtc

SEQ ID NO: 5 - DNA, 24 bp, Artificial Sequence
  Description of Artificial Sequence: Synthetic oligonucleotide
ggaggactccgatcggagtcctcc

SEQ ID NO: 6 - DNA, 24 bp, Artificial Sequence
  Description of Artificial Sequence: Synthetic oligonucleotide
ggcagactccgatcggagtctgcc

SEQ ID NO: 7 - DNA, 24 bp, Artificial Sequence
  Description of Artificial Sequence: Synthetic oligonucleotide
tgcggactccgatcggagtccgca

SEQ ID NO: 8 - DNA, 24 bp, Artificial Sequence
  Description of Artificial Sequence: Synthetic oligonucleotide
gtcggactccgatcggagtccgac

SEQ ID NO: 9 - DNA, 24 bp, Artificial Sequence
  Description of Artificial Sequence: Synthetic oligonucleotide
ggtggactccgatcggagtccacc

SEQ ID NO: 10 - DNA, 24 bp, Artificial Sequence
  Description of Artificial Sequence: Synthetic oligonucleotide
ggctgactccgatcggagtcagcc

SEQ ID NO: 11 - DNA, 24 bp, Artificial Sequence
  Description of Artificial Sequence: Synthetic oligonucleotide
gcccgactccgatcggagtcgggc

SEQ ID NO: 12 - DNA, 24 bp, Artificial Sequence
  Description of Artificial Sequence: Synthetic oligonucleotide
acccgactccgatcggagtcgggt

SEQ ID NO: 13 - DNA, 24 bp, Artificial Sequence
  Description of Artificial Sequence: Synthetic oligonucleotide
gaccgactccgatcggagtcggtc

SEQ ID NO: 14 - DNA, 24 bp, Artificial Sequence
  Description of Artificial Sequence: Synthetic oligonucleotide
gcacgactccgatcggagtcgtgc

SEQ ID NO: 15 - DNA, 24 bp, Artificial Sequence
  Description of Artificial Sequence: Synthetic oligonucleotide
gccagactccgatcggagtctggc

SEQ ID NO: 16 - DNA, 24 bp, Artificial Sequence
  Description of Artificial Sequence: Synthetic oligonucleotide
tcccgactccgatcggagtcggga

SEQ ID NO: 17 - DNA, 24 bp, Artificial Sequence
  Description of Artificial Sequence: Synthetic oligonucleotide
gtccgactccgatcggagtcggac

SEQ ID NO: 18 - DNA, 24 bp, Artificial Sequence
  Description of Artificial Sequence: Synthetic oligonucleotide
gcctgactccgatcggagtcaggc

SEQ ID NO: 19 - DNA, 24 bp, Artificial Sequence
  Description of Artificial Sequence: Synthetic oligonucleotide
gggcgactccgatcggagtcgccc

SEQ ID NO: 20 - DNA, 24 bp, Artificial Sequence
  Description of Artificial Sequence: Synthetic oligonucleotide
aggcgactccgatcggagtcgcct

SEQ ID NO: 21 - DNA, 24 bp, Artificial Sequence
  Description of Artificial Sequence: Synthetic oligonucleotide
gagcgactccgatcggagtcgctc

SEQ ID NO: 22 - DNA, 24 bp, Artificial Sequence
  Description of Artificial Sequence: Synthetic oligonucleotide
ggacgactccgatcggagtcgtcc

SEQ ID NO: 23 - DNA, 24 bp, Artificial Sequence
  Description of Artificial Sequence: Synthetic oligonucleotide
gggagactccgatcggagtctccc

SEQ ID NO: 24 - DNA, 24 bp, Artificial Sequence
  Description of Artificial Sequence: Synthetic oligonucleotide
tggcgactccgatcggagtcgcca

SEQ ID NO: 25 - DNA, 24 bp, Artificial Sequence
  Description of Artificial Sequence: Synthetic oligonucleotide
gtgcgactccgatcggagtcgcac

SEQ ID NO: 26 - DNA, 24 bp, Artificial Sequence
  Description of Artificial Sequence: Synthetic oligonucleotide
gggtgactccgatcggagtcaccc

SEQ ID NO: 27 - DNA, 24 bp, Artificial Sequence
  Description of Artificial Sequence: Synthetic oligonucleotide
acgggactccgatcggagtcccgt

SEQ ID NO: 28 - DNA, 24 bp, Artificial Sequence
  Description of Artificial Sequence: Synthetic oligonucleotide
cagggactccgatcggagtccctg

SEQ ID NO: 29 - DNA, 24 bp, Artificial Sequence
  Description of Artificial Sequence: Synthetic oligonucleotide
ccaggactccgatcggagtcctgg

SEQ ID NO: 30 - DNA, 24 bp, Artificial Sequence
  Description of Artificial Sequence: Synthetic oligonucleotide
ccgagactccgatcggagtctcgg

SEQ ID NO: 31 - DNA, 24 bp, Artificial Sequence
  Description of Artificial Sequence: Synthetic oligonucleotide
tcgggactccgatcggagtcccga

SEQ ID NO: 32 - DNA, 24 bp, Artificial Sequence
  Description of Artificial Sequence: Synthetic oligonucleotide
ctgggactccgatcggagtcccag

SEQ ID NO: 33 - DNA, 24 bp, Artificial Sequence
  Description of Artificial Sequence: Synthetic oligonucleotide
cctggactccgatcggagtccagg

SEQ ID NO: 34 - DNA, 24 bp, Artificial Sequence
  Description of Artificial Sequence: Synthetic oligonucleotide
ccgtgactccgatcggagtcacgg

SEQ ID NO: 35 - DNA, 24 bp, Artificial Sequence
  Description of Artificial Sequence: Synthetic oligonucleotide
cggcgactccgatcggagtcgccg

SEQ ID NO: 36 - DNA, 24 bp, Artificial Sequence
  Description of Artificial Sequence: Synthetic oligonucleotide
cagcgactccgatcggagtcgctg

SEQ ID NO: 37 - DNA, 24 bp, Artificial Sequence
  Description of Artificial Sequence: Synthetic oligonucleotide
cgacgactccgatcggagtcgtcg

SEQ ID NO: 38 - DNA, 24 bp, Artificial Sequence
  Description of Artificial Sequence: Synthetic oligonucleotide
cggagactccgatcggagtctccg

SEQ ID NO: 39 - DNA, 24 bp, Artificial Sequence
  Description of Artificial Sequence: Synthetic oligonucleotide
ctgcgactccgatcggagtcgcag

SEQ ID NO: 40 - DNA, 24 bp, Artificial Sequence
  Description of Artificial Sequence: Synthetic oligonucleotide
cggtgactccgatcggagtcaccg

SEQ ID NO: 41 - DNA, 24 bp, Artificial Sequence
  Description of Artificial Sequence: Synthetic oligonucleotide
cacggactccgatcggagtccgtg

SEQ ID NO: 42 - DNA, 24 bp, Artificial Sequence
  Description of Artificial Sequence: Synthetic oligonucleotide
cccagactccgatcggagtctggg

SEQ ID NO: 43 - DNA, 24 bp, Artificial Sequence
  Description of Artificial Sequence: Synthetic oligonucleotide
ctcggactccgatcggagtccgag

SEQ ID NO: 44 - DNA, 24 bp, Artificial Sequence
  Description of Artificial Sequence: Synthetic oligonucleotide
ccctgactccgatcggagtcaggg

SEQ ID NO: 45 - DNA, 24 bp, Artificial Sequence
  Description of Artificial Sequence: Synthetic oligonucleotide
ccacgactccgatcggagtcgtgg

SEQ ID NO: 46 - DNA, 24 bp, Artificial Sequence
  Description of Artificial Sequence: Synthetic oligonucleotide
agccgactccgatcggagtcggct

SEQ ID NO: 47 - DNA, 24 bp, Artificial Sequence
  Description of Artificial Sequence: Synthetic oligonucleotide
tgccgactccgatcggagtcggca

SEQ ID NO: 48 - DNA, 24 bp, Artificial Sequence
  Description of Artificial Sequence: Synthetic oligonucleotide
gcgagactccgatcggagtctcgc

SEQ ID NO: 49 - DNA, 24 bp, Artificial Sequence
  Description of Artificial Sequence: Synthetic oligonucleotide
gcgtgactccgatcggagtcacgc

SEQ ID NO: 50 - DNA, 24 bp, Artificial Sequence
  Description of Artificial Sequence: Synthetic oligonucleotide
gcaggactccgatcggagtcctgc

SEQ ID NO: 51 - DNA, 24 bp, Artificial Sequence
  Description of Artificial Sequence: Synthetic oligonucleotide
gctggactccgatcggagtccagc

SEQ ID NO: 52 - DNA, 24 bp, Artificial Sequence
  Description of Artificial Sequence: Synthetic oligonucleotide
cgaggactccgatcggagtcctcg

SEQ ID NO: 53 - DNA, 24 bp, Artificial Sequence
  Description of Artificial Sequence: Synthetic oligonucleotide
cgtggactccgatcggagtccacg

SEQ ID NO: 54 - DNA, 24 bp, Artificial Sequence
  Description of Artificial Sequence: Synthetic oligonucleotide
caccgactccgatcggagtcggtg

SEQ ID NO: 55 - DNA, 24 bp, Artificial Sequence
  Description of Artificial Sequence: Synthetic oligonucleotide
ctccgactccgatcggagtcggag

SEQ ID NO: 56 - DNA, 24 bp, Artificial Sequence
  Description of Artificial Sequence: Synthetic oligonucleotide
gcgggactccgatcggagtcccgc

SEQ ID NO: 57 - DNA, 24 bp, Artificial Sequence
  Description of Artificial Sequence: Synthetic oligonucleotide
gagggactccgatcggagtccctc

SEQ ID NO: 58 - DNA, 24 bp, Artificial Sequence
  Description of Artificial Sequence: Synthetic oligonucleotide
gtgggactccgatcggagtcccac

SEQ ID NO: 59 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccgtacggagtcnnnn

SEQ ID NO: 60 - DNA, 24 bp, Artificial Sequence
  Description of Artificial Sequence: Synthetic oligonucleotide
ggcggactccgtacggagtccgcc

SEQ ID NO: 61 - DNA, 24 bp, Artificial Sequence
  Description of Artificial Sequence: Synthetic oligonucleotide
agcggactccgtacggagtccgct

SEQ ID NO: 62 - DNA, 24 bp, Artificial Sequence
  Description of Artificial Sequence: Synthetic oligonucleotide
gacggactccgtacggagtccgtc

SEQ ID NO: 63 - DNA, 24 bp, Artificial Sequence
  Description of Artificial Sequence: Synthetic oligonucleotide
ggaggactccgtacggagtcctcc

SEQ ID NO: 64 - DNA, 24 bp, Artificial Sequence
  Description of Artificial Sequence: Synthetic oligonucleotide
ggcagactccgtacggagtctgcc

SEQ ID NO: 65 - DNA, 24 bp, Artificial Sequence
  Description of Artificial Sequence: Synthetic oligonucleotide
tgcggactccgtacggagtccgca

SEQ ID NO: 66 - DNA, 24 bp, Artificial Sequence
  Description of Artificial Sequence: Synthetic oligonucleotide
gtcggactccgtacggagtccgac

SEQ ID NO: 67 - DNA, 24 bp, Artificial Sequence
  Description of Artificial Sequence: Synthetic oligonucleotide
ggtggactccgtacggagtccacc

SEQ ID NO: 68 - DNA, 24 bp, Artificial Sequence
  Description of Artificial Sequence: Synthetic oligonucleotide
ggctgactccgtacggagtcagcc

SEQ ID NO: 69 - DNA, 24 bp, Artificial Sequence
  Description of Artificial Sequence: Synthetic oligonucleotide
gcccgactccgtacggagtcgggc

SEQ ID NO: 70 - DNA, 24 bp, Artificial Sequence
  Description of Artificial Sequence: Synthetic oligonucleotide
acccgactccgtacggagtcgggt

SEQ ID NO: 71 - DNA, 24 bp, Artificial Sequence
  Description of Artificial Sequence: Synthetic oligonucleotide
gaccgactccgtacggagtcggtc

SEQ ID NO: 72 - DNA, 24 bp, Artificial Sequence
  Description of Artificial Sequence: Synthetic oligonucleotide
gcacgactccgtacggagtcgtgc

SEQ ID NO: 73 - DNA, 24 bp, Artificial Sequence
  Description of Artificial Sequence: Synthetic oligonucleotide
gccagactccgtacggagtctggc

SEQ ID NO: 74 - DNA, 24 bp, Artificial Sequence
  Description of Artificial Sequence: Synthetic oligonucleotide
tcccgactccgtacggagtcggga

SEQ ID NO: 75 - DNA, 24 bp, Artificial Sequence
  Description of Artificial Sequence: Synthetic oligonucleotide
gtccgactccgtacggagtcggac

SEQ ID NO: 76 - DNA, 24 bp, Artificial Sequence
  Description of Artificial Sequence: Synthetic oligonucleotide
gcctgactccgtacggagtcaggc

SEQ ID NO: 77 - DNA, 24 bp, Artificial Sequence
  Description of Artificial Sequence: Synthetic oligonucleotide
gggcgactccgtacggagtcgccc

SEQ ID NO: 78 - DNA, 24 bp, Artificial Sequence
  Description of Artificial Sequence: Synthetic oligonucleotide
aggcgactccgtacggagtcgcct

SEQ ID NO: 79 - DNA, 24 bp, Artificial Sequence
  Description of Artificial Sequence: Synthetic oligonucleotide
gagcgactccgtacggagtcgctc

SEQ ID NO: 80 - DNA, 24 bp, Artificial Sequence
  Description of Artificial Sequence: Synthetic oligonucleotide
ggacgactccgtacggagtcgtcc

SEQ ID NO: 81 - DNA, 24 bp, Artificial Sequence
  Description of Artificial Sequence: Synthetic oligonucleotide
gggagactccgtacggagtctccc

SEQ ID NO: 82 - DNA, 24 bp, Artificial Sequence
  Description of Artificial Sequence: Synthetic oligonucleotide
tggcgactccgtacggagtcgcca

SEQ ID NO: 83 - DNA, 24 bp, Artificial Sequence
  Description of Artificial Sequence: Synthetic oligonucleotide
gtgcgactccgtacggagtcgcac

SEQ ID NO: 84 - DNA, 24 bp, Artificial Sequence
  Description of Artificial Sequence: Synthetic oligonucleotide
gggtgactccgtacggagtcaccc

SEQ ID NO: 85 - DNA, 24 bp, Artificial Sequence
  Description of Artificial Sequence: Synthetic oligonucleotide
acgggactccgtacggagtcccgt

SEQ ID NO: 86 - DNA, 24 bp, Artificial Sequence
  Description of Artificial Sequence: Synthetic oligonucleotide
cagggactccgtacggagtccctg

SEQ ID NO: 87 - DNA, 24 bp, Artificial Sequence
  Description of Artificial Sequence: Synthetic oligonucleotide
ccaggactccgtacggagtcctgg

SEQ ID NO: 88 - DNA, 24 bp, Artificial Sequence
  Description of Artificial Sequence: Synthetic oligonucleotide
ccgagactccgtacggagtctcgg

SEQ ID NO: 89 - DNA, 24 bp, Artificial Sequence
  Description of Artificial Sequence: Synthetic oligonucleotide
tcgggactccgtacggagtcccga

SEQ ID NO: 90 - DNA, 24 bp, Artificial Sequence
  Description of Artificial Sequence: Synthetic oligonucleotide
ctgggactccgtacggagtcccag

SEQ ID NO: 91 - DNA, 24 bp, Artificial Sequence
  Description of Artificial Sequence: Synthetic oligonucleotide
cctggactccgtacggagtccagg

SEQ ID NO: 92 - DNA, 24 bp, Artificial Sequence
  Description of Artificial Sequence: Synthetic oligonucleotide
ccgtgactccgtacggagtcacgg

SEQ ID NO: 93 - DNA, 24 bp, Artificial Sequence
  Description of Artificial Sequence: Synthetic oligonucleotide
cggcgactccgtacggagtcgccg

SEQ ID NO: 94 - DNA, 24 bp, Artificial Sequence
  Description of Artificial Sequence: Synthetic oligonucleotide
cagcgactccgtacggagtcgctg

SEQ ID NO: 95 - DNA, 24 bp, Artificial Sequence
  Description of Artificial Sequence: Synthetic oligonucleotide
cgacgactccgtacggagtcgtcg

SEQ ID NO: 96 - DNA, 24 bp, Artificial Sequence
  Description of Artificial Sequence: Synthetic oligonucleotide
cggagactccgtacggagtctccg

SEQ ID NO: 97 - DNA, 24 bp, Artificial Sequence
  Description of Artificial Sequence: Synthetic oligonucleotide
ctgcgactccgtacggagtcgcag

SEQ ID NO: 98 - DNA, 24 bp, Artificial Sequence
  Description of Artificial Sequence: Synthetic oligonucleotide
cggtgactccgtacggagtcaccg

SEQ ID NO: 99 - DNA, 24 bp, Artificial Sequence
  Description of Artificial Sequence: Synthetic oligonucleotide
cacggactccgtacggagtccgtg

SEQ ID NO: 100 - DNA, 24 bp, Artificial Sequence
  Description of Artificial Sequence: Synthetic oligonucleotide
cccagactccgtacggagtctggg

SEQ ID NO: 101 - DNA, 24 bp, Artificial Sequence
  Description of Artificial Sequence: Synthetic oligonucleotide
ctcggactccgtacggagtccgag

SEQ ID NO: 102 - DNA, 24 bp, Artificial Sequence
  Description of Artificial Sequence: Synthetic oligonucleotide
ccctgactccgtacggagtcaggg

SEQ ID NO: 103 - DNA, 24 bp, Artificial Sequence
  Description of Artificial Sequence: Synthetic oligonucleotide
ccacgactccgtacggagtcgtgg

SEQ ID NO: 104 - DNA, 24 bp, Artificial Sequence
  Description of Artificial Sequence: Synthetic oligonucleotide
agccgactccgtacggagtcggct

SEQ ID NO: 105 - DNA, 24 bp, Artificial Sequence
  Description of Artificial Sequence: Synthetic oligonucleotide
tgccgactccgtacggagtcggca

SEQ ID NO: 106 - DNA, 24 bp, Artificial Sequence
  Description of Artificial Sequence: Synthetic oligonucleotide
gcgagactccgtacggagtctcgc

SEQ ID NO: 107 - DNA, 24 bp, Artificial Sequence
  Description of Artificial Sequence: Synthetic oligonucleotide
gcgtgactccgtacggagtcacgc

SEQ ID NO: 108 - DNA, 24 bp, Artificial Sequence
  Description of Artificial Sequence: Synthetic oligonucleotide
gcaggactccgtacggagtcctgc

SEQ ID NO: 109 - DNA, 24 bp, Artificial Sequence
  Description of Artificial Sequence: Synthetic oligonucleotide
gctggactccgtacggagtccagc

SEQ ID NO: 110 - DNA, 24 bp, Artificial Sequence
  Description of Artificial Sequence: Synthetic oligonucleotide
cgaggactccgtacggagtcctcg

SEQ ID NO: 111 - DNA, 24 bp, Artificial Sequence
  Description of Artificial Sequence: Synthetic oligonucleotide
cgtggactccgtacggagtccacg

SEQ ID NO: 112 - DNA, 24 bp, Artificial Sequence
  Description of Artificial Sequence: Synthetic oligonucleotide
caccgactccgtacggagtcggtg

SEQ ID NO: 113 - DNA, 24 bp, Artificial Sequence
  Description of Artificial Sequence: Synthetic oligonucleotide
ctccgactccgtacggagtcggag

SEQ ID NO: 114 - DNA, 24 bp, Artificial Sequence
  Description of Artificial Sequence: Synthetic oligonucleotide
gcgggactccgtacggagtcccgc

SEQ ID NO: 115 - DNA, 24 bp, Artificial Sequence
  Description of Artificial Sequence: Synthetic oligonucleotide
gagggactccgtacggagtccctc

SEQ ID NO: 116 - DNA, 24 bp, Artificial Sequence
  Description of Artificial Sequence: Synthetic oligonucleotide
gtgggactccgtacggagtcccac

SEQ ID NO: 117 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccggccggagtcnnnn

SEQ ID NO: 118 - DNA, 24 bp, Artificial Sequence
  Description of Artificial Sequence: Synthetic oligonucleotide
ggcggactccggccggagtccgcc

SEQ ID NO: 119 - DNA, 24 bp, Artificial Sequence
  Description of Artificial Sequence: Synthetic oligonucleotide
agcggactccggccggagtccgct

SEQ ID NO: 120 - DNA, 24 bp, Artificial Sequence
  Description of Artificial Sequence: Synthetic oligonucleotide
gacggactccggccggagtccgtc

SEQ ID NO: 121 - DNA, 24 bp, Artificial Sequence
  Description of Artificial Sequence: Synthetic oligonucleotide
ggaggactccggccggagtcctcc

SEQ ID NO: 122 - DNA, 24 bp, Artificial Sequence
  Description of Artificial Sequence: Synthetic oligonucleotide
ggcagactccggccggagtctgcc

SEQ ID NO: 123 - DNA, 24 bp, Artificial Sequence
  Description of Artificial Sequence: Synthetic oligonucleotide
tgcggactccggccggagtccgca

SEQ ID NO: 124 - DNA, 24 bp, Artificial Sequence
  Description of Artificial Sequence: Synthetic oligonucleotide
gtcggactccggccggagtccgac

SEQ ID NO: 125 - DNA, 24 bp, Artificial Sequence
  Description of Artificial Sequence: Synthetic oligonucleotide
ggtggactccggccggagtccacc

SEQ ID NO: 126 - DNA, 24 bp, Artificial Sequence
  Description of Artificial Sequence: Synthetic oligonucleotide
ggctgactccggccggagtcagcc

SEQ ID NO: 127 - DNA, 24 bp, Artificial Sequence
  Description of Artificial Sequence: Synthetic oligonucleotide
gcccgactccggccggagtcgggc

SEQ ID NO: 128 - DNA, 24 bp, Artificial Sequence
  Description of Artificial Sequence: Synthetic oligonucleotide
acccgactccggccggagtcgggt

SEQ ID NO: 129 - DNA, 24 bp, Artificial Sequence
  Description of Artificial Sequence: Synthetic oligonucleotide
gaccgactccggccggagtcggtc

SEQ ID NO: 130 - DNA, 24 bp, Artificial Sequence
  Description of Artificial Sequence: Synthetic oligonucleotide
gcacgactccggccggagtcgtgc

SEQ ID NO: 131 - DNA, 24 bp, Artificial Sequence
  Description of Artificial Sequence: Synthetic oligonucleotide
gccagactccggccggagtctggc

SEQ ID NO: 132 - DNA, 24 bp, Artificial Sequence
  Description of Artificial Sequence: Synthetic oligonucleotide
tcccgactccggccggagtcggga

SEQ ID NO: 133 - DNA, 24 bp, Artificial Sequence
  Description of Artificial Sequence: Synthetic oligonucleotide
gtccgactccggccggagtcggac

SEQ ID NO: 134 - DNA, 24 bp, Artificial Sequence
  Description of Artificial Sequence: Synthetic oligonucleotide
gcctgactccggccggagtcaggc

SEQ ID NO: 135 - DNA, 24 bp, Artificial Sequence
  Description of Artificial Sequence: Synthetic oligonucleotide
gggcgactccggccggagtcgccc

SEQ ID NO: 136 - DNA, 24 bp, Artificial Sequence
  Description of Artificial Sequence: Synthetic oligonucleotide
aggcgactccggccggagtcgcct

SEQ ID NO: 137 - DNA, 24 bp, Artificial Sequence
  Description of Artificial Sequence: Synthetic oligonucleotide
gagcgactccggccggagtcgctc

SEQ ID NO: 138 - DNA, 24 bp, Artificial Sequence
  Description of Artificial Sequence: Synthetic oligonucleotide
ggacgactccggccggagtcgtcc

SEQ ID NO: 139 - DNA, 24 bp, Artificial Sequence
  Description of Artificial Sequence: Synthetic oligonucleotide
gggagactccggccggagtctccc

SEQ ID NO: 140 - DNA, 24 bp, Artificial Sequence
  Description of Artificial Sequence: Synthetic oligonucleotide
tggcgactccggccggagtcgcca

SEQ ID NO: 141 - DNA, 24 bp, Artificial Sequence
  Description of Artificial Sequence: Synthetic oligonucleotide
gtgcgactccggccggagtcgcac

SEQ ID NO: 142 - DNA, 24 bp, Artificial Sequence
  Description of Artificial Sequence: Synthetic oligonucleotide
gggtgactccggccggagtcaccc

SEQ ID NO: 143 - DNA, 24 bp, Artificial Sequence
  Description of Artificial Sequence: Synthetic oligonucleotide
acgggactccggccggagtcccgt

SEQ ID NO: 144 - DNA, 24 bp, Artificial Sequence
  Description of Artificial Sequence: Synthetic oligonucleotide
cagggactccggccggagtccctg

SEQ ID NO: 145 - DNA, 24 bp, Artificial Sequence
  Description of Artificial Sequence: Synthetic oligonucleotide
ccaggactccggccggagtcctgg

SEQ ID NO: 146 - DNA, 24 bp, Artificial Sequence
  Description of Artificial Sequence: Synthetic oligonucleotide
ccgagactccggccggagtctcgg

SEQ ID NO: 147 - DNA, 24 bp, Artificial Sequence
  Description of Artificial Sequence: Synthetic oligonucleotide
tcgggactccggccggagtcccga

SEQ ID NO: 148 - DNA, 24 bp, Artificial Sequence
  Description of Artificial Sequence: Synthetic oligonucleotide
ctgggactccggccggagtcccag

SEQ ID NO: 149 - DNA, 24 bp, Artificial Sequence
  Description of Artificial Sequence: Synthetic oligonucleotide
cctggactccggccggagtccagg

SEQ ID NO: 150 - DNA, 24 bp, Artificial Sequence
  Description of Artificial Sequence: Synthetic oligonucleotide
ccgtgactccggccggagtcacgg

SEQ ID NO: 151 - DNA, 24 bp, Artificial Sequence
  Description of Artificial Sequence: Synthetic oligonucleotide
cggcgactccggccggagtcgccg

SEQ ID NO: 152 - DNA, 24 bp, Artificial Sequence
  Description of Artificial Sequence: Synthetic oligonucleotide
cagcgactccggccggagtcgctg

SEQ ID NO: 153 - DNA, 24 bp, Artificial Sequence
  Description of Artificial Sequence: Synthetic oligonucleotide
cgacgactccggccggagtcgtcg

SEQ ID NO: 154 - DNA, 24 bp, Artificial Sequence
  Description of Artificial Sequence: Synthetic oligonucleotide
cggagactccggccggagtctccg

SEQ ID NO: 155 - DNA, 24 bp, Artificial Sequence
  Description of Artificial Sequence: Synthetic oligonucleotide
ctgcgactccggccggagtcgcag

SEQ ID NO: 156 - DNA, 24 bp, Artificial Sequence
  Description of Artificial Sequence: Synthetic oligonucleotide
cggtgactccggccggagtcaccg

SEQ ID NO: 157 - DNA, 24 bp, Artificial Sequence
  Description of Artificial Sequence: Synthetic oligonucleotide
cacggactccggccggagtccgtg

SEQ ID NO: 158 - DNA, 24 bp, Artificial Sequence
  Description of Artificial Sequence: Synthetic oligonucleotide
cccagactccggccggagtctggg

SEQ ID NO: 159 - DNA, 24 bp, Artificial Sequence
  Description of Artificial Sequence: Synthetic oligonucleotide
ctcggactccggccggagtccgag

SEQ ID NO: 160 - DNA, 24 bp, Artificial Sequence
  Description of Artificial Sequence: Synthetic oligonucleotide
ccctgactccggccggagtcaggg

SEQ ID NO: 161 - DNA, 24 bp, Artificial Sequence
  Description of Artificial Sequence: Synthetic oligonucleotide
ccacgactccggccggagtcgtgg

SEQ ID NO: 162 - DNA, 24 bp, Artificial Sequence
  Description of Artificial Sequence: Synthetic oligonucleotide
agccgactccggccggagtcggct

SEQ ID NO: 163 - DNA, 24 bp, Artificial Sequence
  Description of Artificial Sequence: Synthetic oligonucleotide
tgccgactccggccggagtcggca

SEQ ID NO: 164 - DNA, 24 bp, Artificial Sequence
  Description of Artificial Sequence: Synthetic oligonucleotide
gcgagactccggccggagtctcgc

SEQ ID NO: 165 - DNA, 24 bp, Artificial Sequence
  Description of Artificial Sequence: Synthetic oligonucleotide
gcgtgactccggccggagtcacgc

SEQ ID NO: 166 - DNA, 24 bp, Artificial Sequence
  Description of Artificial Sequence: Synthetic oligonucleotide
gcaggactccggccggagtcctgc

SEQ ID NO: 167 - DNA, 24 bp, Artificial Sequence
  Description of Artificial Sequence: Synthetic oligonucleotide
gctggactccggccggagtccagc

SEQ ID NO: 168 - DNA, 24 bp, Artificial Sequence
  Description of Artificial Sequence: Synthetic oligonucleotide
cgaggactccggccggagtcctcg

SEQ ID NO: 169 - DNA, 24 bp, Artificial Sequence
  Description of Artificial Sequence: Synthetic oligonucleotide
cgtggactccggccggagtccacg

SEQ ID NO: 170 - DNA, 24 bp, Artificial Sequence
  Description of Artificial Sequence: Synthetic oligonucleotide
caccgactccggccggagtcggtg

SEQ ID NO: 171 - DNA, 24 bp, Artificial Sequence
  Description of Artificial Sequence: Synthetic oligonucleotide
ctccgactccggccggagtcggag

SEQ ID NO: 172 - DNA, 24 bp, Artificial Sequence
  Description of Artificial Sequence: Synthetic oligonucleotide
gcgggactccggccggagtcccgc

SEQ ID NO: 173 - DNA, 24 bp, Artificial Sequence
  Description of Artificial Sequence: Synthetic oligonucleotide
gagggactccggccggagtccctc

SEQ ID NO: 174 - DNA, 24 bp, Artificial Sequence
  Description of Artificial Sequence: Synthetic oligonucleotide
gtgggactccggccggagtcccac

SEQ ID NO: 175 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccgcgcggagtcnnnn

SEQ ID NO: 176 - DNA, 24 bp, Artificial Sequence
  Description of Artificial Sequence: Synthetic oligonucleotide
ggcggactccgcgcggagtccgcc

SEQ ID NO: 177 - DNA, 24 bp, Artificial Sequence
  Description of Artificial Sequence: Synthetic oligonucleotide
agcggactccgcgcggagtccgct

SEQ ID NO: 178 - DNA, 24 bp, Artificial Sequence
  Description of Artificial Sequence: Synthetic oligonucleotide
gacggactccgcgcggagtccgtc

SEQ ID NO: 179 - DNA, 24 bp, Artificial Sequence
  Description of Artificial Sequence: Synthetic oligonucleotide
ggaggactccgcgcggagtcctcc

SEQ ID NO: 180 - DNA, 24 bp, Artificial Sequence
  Description of Artificial Sequence: Synthetic oligonucleotide
ggcagactccgcgcggagtctgcc

SEQ ID NO: 181 - DNA, 24 bp, Artificial Sequence
  Description of Artificial Sequence: Synthetic oligonucleotide
tgcggactccgcgcggagtccgca

SEQ ID NO: 182 - DNA, 24 bp, Artificial Sequence
  Description of Artificial Sequence: Synthetic oligonucleotide
gtcggactccgcgcggagtccgac

SEQ ID NO: 183 - DNA, 24 bp, Artificial Sequence
  Description of Artificial Sequence: Synthetic oligonucleotide
ggtggactccgcgcggagtccacc

SEQ ID NO: 184 - DNA, 24 bp, Artificial Sequence
  Description of Artificial Sequence: Synthetic oligonucleotide
ggctgactccgcgcggagtcagcc

SEQ ID NO: 185 - DNA, 24 bp, Artificial Sequence
  Description of Artificial Sequence: Synthetic oligonucleotide
gcccgactccgcgcggagtcgggc

SEQ ID NO: 186 - DNA, 24 bp, Artificial Sequence
  Description of Artificial Sequence: Synthetic oligonucleotide
acccgactccgcgcggagtcgggt

SEQ ID NO: 187 - DNA, 24 bp, Artificial Sequence
  Description of Artificial Sequence: Synthetic oligonucleotide
gaccgactccgcgcggagtcggtc

SEQ ID NO: 188 - DNA, 24 bp, Artificial Sequence
  Description of Artificial Sequence: Synthetic oligonucleotide
gcacgactccgcgcggagtcgtgc

SEQ ID NO: 189 - DNA, 24 bp, Artificial Sequence
  Description of Artificial Sequence: Synthetic oligonucleotide
gccagactccgcgcggagtctggc

SEQ ID NO: 190 - DNA, 24 bp, Artificial Sequence
  Description of Artificial Sequence: Synthetic oligonucleotide
tcccgactccgcgcggagtcggga

SEQ ID NO: 191 - DNA, 24 bp, Artificial Sequence
  Description of Artificial Sequence: Synthetic oligonucleotide
gtccgactccgcgcggagtcggac

SEQ ID NO: 192 - DNA, 24 bp, Artificial Sequence
  Description of Artificial Sequence: Synthetic oligonucleotide
gcctgactccgcgcggagtcaggc

SEQ ID NO: 193 - DNA, 24 bp, Artificial Sequence
  Description of Artificial Sequence: Synthetic oligonucleotide
gggcgactccgcgcggagtcgccc

SEQ ID NO: 194 - DNA, 24 bp, Artificial Sequence
  Description of Artificial Sequence: Synthetic oligonucleotide
aggcgactccgcgcggagtcgcct

SEQ ID NO: 195 - DNA, 24 bp, Artificial Sequence
  Description of Artificial Sequence: Synthetic oligonucleotide
gagcgactccgcgcggagtcgctc

SEQ ID NO: 196 - DNA, 24 bp, Artificial Sequence
  Description of Artificial Sequence: Synthetic oligonucleotide
ggacgactccgcgcggagtcgtcc

SEQ ID NO: 197 - DNA, 24 bp, Artificial Sequence
  Description of Artificial Sequence: Synthetic oligonucleotide
gggagactccgcgcggagtctccc

SEQ ID NO: 198 - DNA, 24 bp, Artificial Sequence
  Description of Artificial Sequence: Synthetic oligonucleotide
tggcgactccgcgcggagtcgcca

SEQ ID NO: 199 - DNA, 24 bp, Artificial Sequence
  Description of Artificial Sequence: Synthetic oligonucleotide
gtgcgactccgcgcggagtcgcac

SEQ ID NO: 200 - DNA, 24 bp, Artificial Sequence
  Description of Artificial Sequence: Synthetic oligonucleotide
gggtgactccgcgcggagtcaccc

SEQ ID NO: 201 - DNA, 24 bp, Artificial Sequence
  Description of Artificial Sequence: Synthetic oligonucleotide
acgggactccgcgcggagtcccgt

SEQ ID NO: 202 - DNA, 24 bp, Artificial Sequence
  Description of Artificial Sequence: Synthetic oligonucleotide
cagggactccgcgcggagtccctg

SEQ ID NO: 203 - DNA, 24 bp, Artificial Sequence
  Description of Artificial Sequence: Synthetic oligonucleotide
ccaggactccgcgcggagtcctgg

SEQ ID NO: 204 - DNA, 24 bp, Artificial Sequence
  Description of Artificial Sequence: Synthetic oligonucleotide
ccgagactccgcgcggagtctcgg

SEQ ID NO: 205 - DNA, 24 bp, Artificial Sequence
  Description of Artificial Sequence: Synthetic oligonucleotide
tcgggactccgcgcggagtcccga

SEQ ID NO: 206 - DNA, 24 bp, Artificial Sequence
  Description of Artificial Sequence: Synthetic oligonucleotide
ctgggactccgcgcggagtcccag

SEQ ID NO: 207 - DNA, 24 bp, Artificial Sequence
  Description of Artificial Sequence: Synthetic oligonucleotide
cctggactccgcgcggagtccagg

SEQ ID NO: 208 - DNA, 24 bp, Artificial Sequence
  Description of Artificial Sequence: Synthetic oligonucleotide
ccgtgactccgcgcggagtcacgg

SEQ ID NO: 209 - DNA, 24 bp, Artificial Sequence
  Description of Artificial Sequence: Synthetic oligonucleotide
cggcgactccgcgcggagtcgccg

SEQ ID NO: 210 - DNA, 24 bp, Artificial Sequence
  Description of Artificial Sequence: Synthetic oligonucleotide
cagcgactccgcgcggagtcgctg

SEQ ID NO: 211 - DNA, 24 bp, Artificial Sequence
  Description of Artificial Sequence: Synthetic oligonucleotide
cgacgactccgcgcggagtcgtcg

SEQ ID NO: 212 - DNA, 24 bp, Artificial Sequence
  Description of Artificial Sequence: Synthetic oligonucleotide
cggagactccgcgcggagtctccg

SEQ ID NO: 213 - DNA, 24 bp, Artificial Sequence
  Description of Artificial Sequence: Synthetic oligonucleotide
ctgcgactccgcgcggagtcgcag

SEQ ID NO: 214 - DNA, 24 bp, Artificial Sequence
  Description of Artificial Sequence: Synthetic oligonucleotide
cggtgactccgcgcggagtcaccg

SEQ ID NO: 215 - DNA, 24 bp, Artificial Sequence
  Description of Artificial Sequence: Synthetic oligonucleotide
cacggactccgcgcggagtccgtg

SEQ ID NO: 216 - DNA, 24 bp, Artificial Sequence
  Description of Artificial Sequence: Synthetic oligonucleotide
cccagactccgcgcggagtctggg

SEQ ID NO: 217 - DNA, 24 bp, Artificial Sequence
  Description of Artificial Sequence: Synthetic oligonucleotide
ctcggactccgcgcggagtccgag

SEQ ID NO: 218 - DNA, 24 bp, Artificial Sequence
  Description of Artificial Sequence: Synthetic oligonucleotide
ccctgactccgcgcggagtcaggg

SEQ ID NO: 219 - DNA, 24 bp, Artificial Sequence
  Description of Artificial Sequence: Synthetic oligonucleotide
ccacgactccgcgcggagtcgtgg

SEQ ID NO: 220 - DNA, 24 bp, Artificial Sequence
  Description of Artificial Sequence: Synthetic oligonucleotide
agccgactccgcgcggagtcggct

SEQ ID NO: 221 - DNA, 24 bp, Artificial Sequence
  Description of Artificial Sequence: Synthetic oligonucleotide
tgccgactccgcgcggagtcggca

SEQ ID NO: 222 - DNA, 24 bp, Artificial Sequence
  Description of Artificial Sequence: Synthetic oligonucleotide
gcgagactccgcgcggagtctcgc

SEQ ID NO: 223 - DNA, 24 bp, Artificial Sequence
  Description of Artificial Sequence: Synthetic oligonucleotide
gcgtgactccgcgcggagtcacgc

SEQ ID NO: 224 - DNA, 24 bp, Artificial Sequence
  Description of Artificial Sequence: Synthetic oligonucleotide
gcaggactccgcgcggagtcctgc

SEQ ID NO: 225 - DNA, 24 bp, Artificial Sequence
  Description of Artificial Sequence: Synthetic oligonucleotide
gctggactccgcgcggagtccagc

SEQ ID NO: 226 - DNA, 24 bp, Artificial Sequence
  Description of Artificial Sequence: Synthetic oligonucleotide
cgaggactccgcgcggagtcctcg

SEQ ID NO: 227 - DNA, 24 bp, Artificial Sequence
  Description of Artificial Sequence: Synthetic oligonucleotide
cgtggactccgcgcggagtccacg

SEQ ID NO: 228 - DNA, 24 bp, Artificial Sequence
  Description of Artificial Sequence: Synthetic oligonucleotide
caccgactccgcgcggagtcggtg

SEQ ID NO: 229 - DNA, 24 bp, Artificial Sequence
  Description of Artificial Sequence: Synthetic oligonucleotide
ctccgactccgcgcggagtcggag

SEQ ID NO: 230 - DNA, 24 bp, Artificial Sequence
  Description of Artificial Sequence: Synthetic oligonucleotide
gcgggactccgcgcggagtcccgc

SEQ ID NO: 231 - DNA, 24 bp, Artificial Sequence
  Description of Artificial Sequence: Synthetic oligonucleotide
gagggactccgcgcggagtccctc

SEQ ID NO: 232 - DNA, 24 bp, Artificial Sequence
  Description of Artificial Sequence: Synthetic oligonucleotide
gtgggactccgcgcggagtcccac

SEQ ID NO: 233 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctgatcagagtcnnnn

SEQ ID NO: 234 - DNA, 24 bp, Artificial Sequence
  Description of Artificial Sequence: Synthetic oligonucleotide
ggcggactctgatcagagtccgcc

SEQ ID NO: 235 - DNA, 24 bp, Artificial Sequence
  Description of Artificial Sequence: Synthetic oligonucleotide
agcggactctgatcagagtccgct

SEQ ID NO: 236 - DNA, 24 bp, Artificial Sequence
  Description of Artificial Sequence: Synthetic oligonucleotide
gacggactctgatcagagtccgtc

SEQ ID NO: 237 - DNA, 24 bp, Artificial Sequence
  Description of Artificial Sequence: Synthetic oligonucleotide
ggaggactctgatcagagtcctcc

SEQ ID NO: 238 - DNA, 24 bp, Artificial Sequence
  Description of Artificial Sequence: Synthetic oligonucleotide
ggcagactctgatcagagtctgcc

SEQ ID NO: 239 - DNA, 24 bp, Artificial Sequence
  Description of Artificial Sequence: Synthetic oligonucleotide
tgcggactctgatcagagtccgca

SEQ ID NO: 240 - DNA, 24 bp, Artificial Sequence
  Description of Artificial Sequence: Synthetic oligonucleotide
gtcggactctgatcagagtccgac

SEQ ID NO: 241 - DNA, 24 bp, Artificial Sequence
  Description of Artificial Sequence: Synthetic oligonucleotide
ggtggactctgatcagagtccacc

SEQ ID NO: 242 - DNA, 24 bp, Artificial Sequence
  Description of Artificial Sequence: Synthetic oligonucleotide
ggctgactctgatcagagtcagcc

SEQ ID NO: 243 - DNA, 24 bp, Artificial Sequence
  Description of Artificial Sequence: Synthetic oligonucleotide
gcccgactctgatcagagtcgggc

SEQ ID NO: 244 - DNA, 24 bp, Artificial Sequence
  Description of Artificial Sequence: Synthetic oligonucleotide
acccgactctgatcagagtcgggt

SEQ ID NO: 245 - DNA, 24 bp, Artificial Sequence
  Description of Artificial Sequence: Synthetic oligonucleotide
gaccgactctgatcagagtcggtc

SEQ ID NO: 246 - DNA, 24 bp, Artificial Sequence
  Description of Artificial Sequence: Synthetic oligonucleotide
gcacgactctgatcagagtcgtgc

SEQ ID NO: 247 - DNA, 24 bp, Artificial Sequence
  Description of Artificial Sequence: Synthetic oligonucleotide
gccagactctgatcagagtctggc

SEQ ID NO: 248 - DNA, 24 bp, Artificial Sequence
  Description of Artificial Sequence: Synthetic oligonucleotide
tcccgactctgatcagagtcggga

SEQ ID NO: 249 - DNA, 24 bp, Artificial Sequence
  Description of Artificial Sequence: Synthetic oligonucleotide
gtccgactctgatcagagtcggac

SEQ ID NO: 250 - DNA, 24 bp, Artificial Sequence
  Description of Artificial Sequence: Synthetic oligonucleotide
gcctgactctgatcagagtcaggc

SEQ ID NO: 251 - DNA, 24 bp, Artificial Sequence
  Description of Artificial Sequence: Synthetic oligonucleotide
gggcgactctgatcagagtcgccc

SEQ ID NO: 252 - DNA, 24 bp, Artificial Sequence
  Description of Artificial Sequence: Synthetic oligonucleotide
aggcgactctgatcagagtcgcct

SEQ ID NO: 253 - DNA, 24 bp, Artificial Sequence
  Description of Artificial Sequence: Synthetic oligonucleotide
gagcgactctgatcagagtcgctc

SEQ ID NO: 254 - DNA, 24 bp, Artificial Sequence
  Description of Artificial Sequence: Synthetic oligonucleotide
ggacgactctgatcagagtcgtcc

SEQ ID NO: 255 - DNA, 24 bp, Artificial Sequence
  Description of Artificial Sequence: Synthetic oligonucleotide
gggagactctgatcagagtctccc

SEQ ID NO: 256 - DNA, 24 bp, Artificial Sequence
  Description of Artificial Sequence: Synthetic oligonucleotide
tggcgactctgatcagagtcgcca

SEQ ID NO: 257 - DNA, 24 bp, Artificial Sequence
  Description of Artificial Sequence: Synthetic oligonucleotide
gtgcgactctgatcagagtcgcac

SEQ ID NO: 258 - DNA, 24 bp, Artificial Sequence
  Description of Artificial Sequence: Synthetic oligonucleotide
gggtgactctgatcagagtcaccc

SEQ ID NO: 259 - DNA, 24 bp, Artificial Sequence
  Description of Artificial Sequence: Synthetic oligonucleotide
acgggactctgatcagagtcccgt

SEQ ID NO: 260 - DNA, 24 bp, Artificial Sequence
  Description of Artificial Sequence: Synthetic oligonucleotide
cagggactctgatcagagtccctg

SEQ ID NO: 261 - DNA, 24 bp, Artificial Sequence
  Description of Artificial Sequence: Synthetic oligonucleotide
ccaggactctgatcagagtcctgg

SEQ ID NO: 262 - DNA, 24 bp, Artificial Sequence
  Description of Artificial Sequence: Synthetic oligonucleotide
ccgagactctgatcagagtctcgg

SEQ ID NO: 263 - DNA, 24 bp, Artificial Sequence
  Description of Artificial Sequence: Synthetic oligonucleotide
tcgggactctgatcagagtcccga

SEQ ID NO: 264 - DNA, 24 bp, Artificial Sequence
  Description of Artificial Sequence: Synthetic oligonucleotide
ctgggactctgatcagagtcccag

SEQ ID NO: 265 - DNA, 24 bp, Artificial Sequence
  Description of Artificial Sequence: Synthetic oligonucleotide
cctggactctgatcagagtccagg

SEQ ID NO: 266 - DNA, 24 bp, Artificial Sequence
  Description of Artificial Sequence: Synthetic oligonucleotide
ccgtgactctgatcagagtcacgg

SEQ ID NO: 267 - DNA, 24 bp, Artificial Sequence
  Description of Artificial Sequence: Synthetic oligonucleotide
cggcgactctgatcagagtcgccg

SEQ ID NO: 268 - DNA, 24 bp, Artificial Sequence
  Description of Artificial Sequence: Synthetic oligonucleotide
cagcgactctgatcagagtcgctg

SEQ ID NO: 269 - DNA, 24 bp, Artificial Sequence
  Description of Artificial Sequence: Synthetic oligonucleotide
cgacgactctgatcagagtcgtcg

SEQ ID NO: 270 - DNA, 24 bp, Artificial Sequence
  Description of Artificial Sequence: Synthetic oligonucleotide
cggagactctgatcagagtctccg

SEQ ID NO: 271 - DNA, 24 bp, Artificial Sequence
  Description of Artificial Sequence: Synthetic oligonucleotide
ctgcgactctgatcagagtcgcag

SEQ ID NO: 272 - DNA, 24 bp, Artificial Sequence
  Description of Artificial Sequence: Synthetic oligonucleotide
cggtgactctgatcagagtcaccg

SEQ ID NO: 273 - DNA, 24 bp, Artificial Sequence
  Description of Artificial Sequence: Synthetic oligonucleotide
cacggactctgatcagagtccgtg

SEQ ID NO: 274 - DNA, 24 bp, Artificial Sequence
  Description of Artificial Sequence: Synthetic oligonucleotide
cccagactctgatcagagtctggg

SEQ ID NO: 275 - DNA, 24 bp, Artificial Sequence
  Description of Artificial Sequence: Synthetic oligonucleotide
ctcggactctgatcagagtccgag

SEQ ID NO: 276 - DNA, 24 bp, Artificial Sequence
  Description of Artificial Sequence: Synthetic oligonucleotide
ccctgactctgatcagagtcaggg

SEQ ID NO: 277 - DNA, 24 bp, Artificial Sequence
  Description of Artificial Sequence: Synthetic oligonucleotide
ccacgactctgatcagagtcgtgg

SEQ ID NO: 278 - DNA, 24 bp, Artificial Sequence
  Description of Artificial Sequence: Synthetic oligonucleotide
agccgactctgatcagagtcggct

SEQ ID NO: 279 - DNA, 24 bp, Artificial Sequence
  Description of Artificial Sequence: Synthetic oligonucleotide
tgccgactctgatcagagtcggca

SEQ ID NO: 280 - DNA, 24 bp, Artificial Sequence
  Description of Artificial Sequence: Synthetic oligonucleotide
gcgagactctgatcagagtctcgc

SEQ ID NO: 281 - DNA, 24 bp, Artificial Sequence
  Description of Artificial Sequence: Synthetic oligonucleotide
gcgtgactctgatcagagtcacgc

SEQ ID NO: 282 - DNA, 24 bp, Artificial Sequence
  Description of Artificial Sequence: Synthetic oligonucleotide
gcaggactctgatcagagtcctgc

SEQ ID NO: 283 - DNA, 24 bp, Artificial Sequence
  Description of Artificial Sequence: Synthetic oligonucleotide
gctggactctgatcagagtccagc

SEQ ID NO: 284 - DNA, 24 bp, Artificial Sequence
  Description of Artificial Sequence: Synthetic oligonucleotide
cgaggactctgatcagagtcctcg

SEQ ID NO: 285 - DNA, 24 bp, Artificial Sequence
  Description of Artificial Sequence: Synthetic oligonucleotide
cgtggactctgatcagagtccacg

SEQ ID NO: 286 - DNA, 24 bp, Artificial Sequence
  Description of Artificial Sequence: Synthetic oligonucleotide
caccgactctgatcagagtcggtg

SEQ ID NO: 287 - DNA, 24 bp, Artificial Sequence
  Description of Artificial Sequence: Synthetic oligonucleotide
ctccgactctgatcagagtcggag

SEQ ID NO: 288 - DNA, 24 bp, Artificial Sequence
  Description of Artificial Sequence: Synthetic oligonucleotide
gcgggactctgatcagagtcccgc

SEQ ID NO: 289 - DNA, 24 bp, Artificial Sequence
  Description of Artificial Sequence: Synthetic oligonucleotide
gagggactctgatcagagtccctc

SEQ ID NO: 290 - DNA, 24 bp, Artificial Sequence
  Description of Artificial Sequence: Synthetic oligonucleotide
gtgggactctgatcagagtcccac

SEQ ID NO: 291 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctgtacagagtcnnnn

SEQ ID NO: 292 - DNA, 24 bp, Artificial Sequence
  Description of Artificial Sequence: Synthetic oligonucleotide
ggcggactctgtacagagtccgcc

SEQ ID NO: 293 - DNA, 24 bp, Artificial Sequence
  Description of Artificial Sequence: Synthetic oligonucleotide
agcggactctgtacagagtccgct

SEQ ID NO: 294 - DNA, 24 bp, Artificial Sequence
  Description of Artificial Sequence: Synthetic oligonucleotide
gacggactctgtacagagtccgtc

SEQ ID NO: 295 - DNA, 24 bp, Artificial Sequence
  Description of Artificial Sequence: Synthetic oligonucleotide
ggaggactctgtacagagtcctcc

SEQ ID NO: 296 - DNA, 24 bp, Artificial Sequence
  Description of Artificial Sequence: Synthetic oligonucleotide
ggcagactctgtacagagtctgcc

SEQ ID NO: 297 - DNA, 24 bp, Artificial Sequence
  Description of Artificial Sequence: Synthetic oligonucleotide
tgcggactctgtacagagtccgca

SEQ ID NO: 298 - DNA, 24 bp, Artificial Sequence
  Description of Artificial Sequence: Synthetic oligonucleotide
gtcggactctgtacagagtccgac

SEQ ID NO: 299 - DNA, 24 bp, Artificial Sequence
  Description of Artificial Sequence: Synthetic oligonucleotide
ggtggactctgtacagagtccacc

SEQ ID NO: 300 - DNA, 24 bp, Artificial Sequence
  Description of Artificial Sequence: Synthetic oligonucleotide
ggctgactctgtacagagtcagcc

SEQ ID NO: 301 - DNA, 24 bp, Artificial Sequence
  Description of Artificial Sequence: Synthetic oligonucleotide
gcccgactctgtacagagtcgggc

SEQ ID NO: 302 - DNA, 24 bp, Artificial Sequence
  Description of Artificial Sequence: Synthetic oligonucleotide
acccgactctgtacagagtcgggt

SEQ ID NO: 303 - DNA, 24 bp, Artificial Sequence
  Description of Artificial Sequence: Synthetic oligonucleotide
gaccgactctgtacagagtcggtc

SEQ ID NO: 304 - DNA, 24 bp, Artificial Sequence
  Description of Artificial Sequence: Synthetic oligonucleotide
gcacgactctgtacagagtcgtgc

SEQ ID NO: 305 - DNA, 24 bp, Artificial Sequence
  Description of Artificial Sequence: Synthetic oligonucleotide
gccagactctgtacagagtctggc

SEQ ID NO: 306 - DNA, 24 bp, Artificial Sequence
  Description of Artificial Sequence: Synthetic oligonucleotide
tcccgactctgtacagagtcggga

SEQ ID NO: 307 - DNA, 24 bp, Artificial Sequence
  Description of Artificial Sequence: Synthetic oligonucleotide
gtccgactctgtacagagtcggac

SEQ ID NO: 308 - DNA, 24 bp, Artificial Sequence
  Description of Artificial Sequence: Synthetic oligonucleotide
gcctgactctgtacagagtcaggc

SEQ ID NO: 309 - DNA, 24 bp, Artificial Sequence
  Description of Artificial Sequence: Synthetic oligonucleotide
gggcgactctgtacagagtcgccc

SEQ ID NO: 310 - DNA, 24 bp, Artificial Sequence
  Description of Artificial Sequence: Synthetic oligonucleotide
aggcgactctgtacagagtcgcct

SEQ ID NO: 311 - DNA, 24 bp, Artificial Sequence
  Description of Artificial Sequence: Synthetic oligonucleotide
gagcgactctgtacagagtcgctc

SEQ ID NO: 312 - DNA, 24 bp, Artificial Sequence
  Description of Artificial Sequence: Synthetic oligonucleotide
ggacgactctgtacagagtcgtcc

SEQ ID NO: 313 - DNA, 24 bp, Artificial Sequence
  Description of Artificial Sequence: Synthetic oligonucleotide
gggagactctgtacagagtctccc

SEQ ID NO: 314 - DNA, 24 bp, Artificial Sequence
  Description of Artificial Sequence: Synthetic oligonucleotide
tggcgactctgtacagagtcgcca

SEQ ID NO: 315 - DNA, 24 bp, Artificial Sequence
  Description of Artificial Sequence: Synthetic oligonucleotide
gtgcgactctgtacagagtcgcac

SEQ ID NO: 316 - DNA, 24 bp, Artificial Sequence
  Description of Artificial Sequence: Synthetic oligonucleotide
gggtgactctgtacagagtcaccc

SEQ ID NO: 317 - DNA, 24 bp, Artificial Sequence
  Description of Artificial Sequence: Synthetic oligonucleotide
acgggactctgtacagagtcccgt

SEQ ID NO: 318 - DNA, 24 bp, Artificial Sequence
  Description of Artificial Sequence: Synthetic oligonucleotide
cagggactctgtacagagtccctg

SEQ ID NO: 319 - DNA, 24 bp, Artificial Sequence
  Description of Artificial Sequence: Synthetic oligonucleotide
ccaggactctgtacagagtcctgg

SEQ ID NO: 320 - DNA, 24 bp, Artificial Sequence
  Description of Artificial Sequence: Synthetic oligonucleotide
ccgagactctgtacagagtctcgg

SEQ ID NO: 321 - DNA, 24 bp, Artificial Sequence
  Description of Artificial Sequence: Synthetic oligonucleotide
tcgggactctgtacagagtcccga

SEQ ID NO: 322 - DNA, 24 bp, Artificial Sequence
  Description of Artificial Sequence: Synthetic oligonucleotide
ctgggactctgtacagagtcccag

SEQ ID NO: 323 - DNA, 24 bp, Artificial Sequence
  Description of Artificial Sequence: Synthetic oligonucleotide
cctggactctgtacagagtccagg

SEQ ID NO: 324 - DNA, 24 bp, Artificial Sequence
  Description of Artificial Sequence: Synthetic oligonucleotide
ccgtgactctgtacagagtcacgg

SEQ ID NO: 325 - DNA, 24 bp, Artificial Sequence
  Description of Artificial Sequence: Synthetic oligonucleotide
cggcgactctgtacagagtcgccg

SEQ ID NO: 326 - DNA, 24 bp, Artificial Sequence
  Description of Artificial Sequence: Synthetic oligonucleotide
cagcgactctgtacagagtcgctg

SEQ ID NO: 327 - DNA, 24 bp, Artificial Sequence
  Description of Artificial Sequence: Synthetic oligonucleotide
cgacgactctgtacagagtcgtcg

SEQ ID NO: 328 - DNA, 24 bp, Artificial Sequence
  Description of Artificial Sequence: Synthetic oligonucleotide
cggagactctgtacagagtctccg

SEQ ID NO: 329 - DNA, 24 bp, Artificial Sequence
  Description of Artificial Sequence: Synthetic oligonucleotide
ctgcgactctgtacagagtcgcag

SEQ ID NO: 330 - DNA, 24 bp, Artificial Sequence
  Description of Artificial Sequence: Synthetic oligonucleotide
cggtgactctgtacagagtcaccg

SEQ ID NO: 331 - DNA, 24 bp, Artificial Sequence
  Description of Artificial Sequence: Synthetic oligonucleotide
cacggactctgtacagagtccgtg

SEQ ID NO: 332 - DNA, 24 bp, Artificial Sequence
  Description of Artificial Sequence: Synthetic oligonucleotide
cccagactctgtacagagtctggg

SEQ ID NO: 333 - DNA, 24 bp, Artificial Sequence
  Description of Artificial Sequence: Synthetic oligonucleotide
ctcggactctgtacagagtccgag

SEQ ID NO: 334 - DNA, 24 bp, Artificial Sequence
  Description of Artificial Sequence: Synthetic oligonucleotide
ccctgactctgtacagagtcaggg

SEQ ID NO: 335 - DNA, 24 bp, Artificial Sequence
  Description of Artificial Sequence: Synthetic oligonucleotide
ccacgactctgtacagagtcgtgg

SEQ ID NO: 336 - DNA, 24 bp, Artificial Sequence
  Description of Artificial Sequence: Synthetic oligonucleotide
agccgactctgtacagagtcggct

SEQ ID NO: 337 - DNA, 24 bp, Artificial Sequence
  Description of Artificial Sequence: Synthetic oligonucleotide
tgccgactctgtacagagtcggca

SEQ ID NO: 338 - DNA, 24 bp, Artificial Sequence
  Description of Artificial Sequence: Synthetic oligonucleotide
gcgagactctgtacagagtctcgc

SEQ ID NO: 339 - DNA, 24 bp, Artificial Sequence
  Description of Artificial Sequence: Synthetic oligonucleotide
gcgtgactctgtacagagtcacgc

SEQ ID NO: 340 - DNA, 24 bp, Artificial Sequence
  Description of Artificial Sequence: Synthetic oligonucleotide
gcaggactctgtacagagtcctgc

SEQ ID NO: 341 - DNA, 24 bp, Artificial Sequence
  Description of Artificial Sequence: Synthetic oligonucleotide
gctggactctgtacagagtccagc

SEQ ID NO: 342 - DNA, 24 bp, Artificial Sequence
  Description of Artificial Sequence: Synthetic oligonucleotide
cgaggactctgtacagagtcctcg

SEQ ID NO: 343 - DNA, 24 bp, Artificial Sequence
  Description of Artificial Sequence: Synthetic oligonucleotide
cgtggactctgtacagagtccacg

SEQ ID NO: 344 - DNA, 24 bp, Artificial Sequence
  Description of Artificial Sequence: Synthetic oligonucleotide
caccgactctgtacagagtcggtg

SEQ ID NO: 345 - DNA, 24 bp, Artificial Sequence
  Description of Artificial Sequence: Synthetic oligonucleotide
ctccgactctgtacagagtcggag

SEQ ID NO: 346 - DNA, 24 bp, Artificial Sequence
  Description of Artificial Sequence: Synthetic oligonucleotide
gcgggactctgtacagagtcccgc

SEQ ID NO: 347 - DNA, 24 bp, Artificial Sequence
  Description of Artificial Sequence: Synthetic oligonucleotide
gagggactctgtacagagtccctc

SEQ ID NO: 348 - DNA, 24 bp, Artificial Sequence
  Description of Artificial Sequence: Synthetic oligonucleotide
gtgggactctgtacagagtcccac

SEQ ID NO: 349 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctggccagagtcnnnn

SEQ ID NO: 350 - DNA, 24 bp, Artificial Sequence
  Description of Artificial Sequence: Synthetic oligonucleotide
ggcggactctggccagagtccgcc

SEQ ID NO: 351 - DNA, 24 bp, Artificial Sequence
  Description of Artificial Sequence: Synthetic oligonucleotide
agcggactctggccagagtccgct

SEQ ID NO: 352 - DNA, 24 bp, Artificial Sequence
  Description of Artificial Sequence: Synthetic oligonucleotide
gacggactctggccagagtccgtc

SEQ ID NO: 353 - DNA, 24 bp, Artificial Sequence
  Description of Artificial Sequence: Synthetic oligonucleotide
ggaggactctggccagagtcctcc

SEQ ID NO: 354 - DNA, 24 bp, Artificial Sequence
  Description of Artificial Sequence: Synthetic oligonucleotide
ggcagactctggccagagtctgcc

SEQ ID NO: 355 - DNA, 24 bp, Artificial Sequence
  Description of Artificial Sequence: Synthetic oligonucleotide
tgcggactctggccagagtccgca

SEQ ID NO: 356 - DNA, 24 bp, Artificial Sequence
  Description of Artificial Sequence: Synthetic oligonucleotide
gtcggactctggccagagtccgac

SEQ ID NO: 357 - DNA, 24 bp, Artificial Sequence
  Description of Artificial Sequence: Synthetic oligonucleotide
ggtggactctggccagagtccacc

SEQ ID NO: 358 - DNA, 24 bp, Artificial Sequence
  Description of Artificial Sequence: Synthetic oligonucleotide
ggctgactctggccagagtcagcc

SEQ ID NO: 359 - DNA, 24 bp, Artificial Sequence
  Description of Artificial Sequence: Synthetic oligonucleotide
gcccgactctggccagagtcgggc

SEQ ID NO: 360 - DNA, 24 bp, Artificial Sequence
  Description of Artificial Sequence: Synthetic oligonucleotide
acccgactctggccagagtcgggt

SEQ ID NO: 361 - DNA, 24 bp, Artificial Sequence
  Description of Artificial Sequence: Synthetic oligonucleotide
gaccgactctggccagagtcggtc

SEQ ID NO: 362 - DNA, 24 bp, Artificial Sequence
  Description of Artificial Sequence: Synthetic oligonucleotide
gcacgactctggccagagtcgtgc

SEQ ID NO: 363 - DNA, 24 bp, Artificial Sequence
  Description of Artificial Sequence: Synthetic oligonucleotide
gccagactctggccagagtctggc

SEQ ID NO: 364 - DNA, 24 bp, Artificial Sequence
  Description of Artificial Sequence: Synthetic oligonucleotide
tcccgactctggccagagtcggga

SEQ ID NO: 365 - DNA, 24 bp, Artificial Sequence
  Description of Artificial Sequence: Synthetic oligonucleotide
gtccgactctggccagagtcggac

SEQ ID NO: 366 - DNA, 24 bp, Artificial Sequence
  Description of Artificial Sequence: Synthetic oligonucleotide
gcctgactctggccagagtcaggc

SEQ ID NO: 367 - DNA, 24 bp, Artificial Sequence
  Description of Artificial Sequence: Synthetic oligonucleotide
gggcgactctggccagagtcgccc

SEQ ID NO: 368 - DNA, 24 bp, Artificial Sequence
  Description of Artificial Sequence: Synthetic oligonucleotide
aggcgactctggccagagtcgcct

SEQ ID NO: 369 - DNA, 24 bp, Artificial Sequence
  Description of Artificial Sequence: Synthetic oligonucleotide
gagcgactctggccagagtcgctc

SEQ ID NO: 370 - DNA, 24 bp, Artificial Sequence
  Description of Artificial Sequence: Synthetic oligonucleotide
ggacgactctggccagagtcgtcc

SEQ ID NO: 371 - DNA, 24 bp, Artificial Sequence
  Description of Artificial Sequence: Synthetic oligonucleotide
gggagactctggccagagtctccc

SEQ ID NO: 372 - DNA, 24 bp, Artificial Sequence
  Description of Artificial Sequence: Synthetic oligonucleotide
tggcgactctggccagagtcgcca

SEQ ID NO: 373 - DNA, 24 bp, Artificial Sequence
  Description of Artificial Sequence: Synthetic oligonucleotide
gtgcgactctggccagagtcgcac

SEQ ID NO: 374 - DNA, 24 bp, Artificial Sequence
  Description of Artificial Sequence: Synthetic oligonucleotide
gggtgactctggccagagtcaccc

SEQ ID NO: 375 - DNA, 24 bp, Artificial Sequence
  Description of Artificial Sequence: Synthetic oligonucleotide
acgggactctggccagagtcccgt

SEQ ID NO: 376 - DNA, 24 bp, Artificial Sequence
  Description of Artificial Sequence: Synthetic oligonucleotide
cagggactctggccagagtccctg

SEQ ID NO: 377 - DNA, 24 bp, Artificial Sequence
  Description of Artificial Sequence: Synthetic oligonucleotide
ccaggactctggccagagtcctgg

SEQ ID NO: 378 - DNA, 24 bp, Artificial Sequence
  Description of Artificial Sequence: Synthetic oligonucleotide
ccgagactctggccagagtctcgg

SEQ ID NO: 379 - DNA, 24 bp, Artificial Sequence
  Description of Artificial Sequence: Synthetic oligonucleotide
tcgggactctggccagagtcccga

SEQ ID NO: 380 - DNA, 24 bp, Artificial Sequence
  Description of Artificial Sequence: Synthetic oligonucleotide
ctgggactctggccagagtcccag

SEQ ID NO: 381 - DNA, 24 bp, Artificial Sequence
  Description of Artificial Sequence: Synthetic oligonucleotide
cctggactctggccagagtccagg

SEQ ID NO: 382 - DNA, 24 bp, Artificial Sequence
  Description of Artificial Sequence: Synthetic oligonucleotide
ccgtgactctggccagagtcacgg

SEQ ID NO: 383 - DNA, 24 bp, Artificial Sequence
  Description of Artificial Sequence: Synthetic oligonucleotide
cggcgactctggccagagtcgccg

SEQ ID NO: 384 - DNA, 24 bp, Artificial Sequence
  Description of Artificial Sequence: Synthetic oligonucleotide
cagcgactctggccagagtcgctg

SEQ ID NO: 385 - DNA, 24 bp, Artificial Sequence
  Description of Artificial Sequence: Synthetic oligonucleotide
cgacgactctggccagagtcgtcg

SEQ ID NO: 386 - DNA, 24 bp, Artificial Sequence
  Description of Artificial Sequence: Synthetic oligonucleotide
cggagactctggccagagtctccg

SEQ ID NO: 387 - DNA, 24 bp, Artificial Sequence
  Description of Artificial Sequence: Synthetic oligonucleotide
ctgcgactctggccagagtcgcag

SEQ ID NO: 388 - DNA, 24 bp, Artificial Sequence
  Description of Artificial Sequence: Synthetic oligonucleotide
cggtgactctggccagagtcaccg

SEQ ID NO: 389 - DNA, 24 bp, Artificial Sequence
  Description of Artificial Sequence: Synthetic oligonucleotide
cacggactctggccagagtccgtg

SEQ ID NO: 390 - DNA, 24 bp, Artificial Sequence
  Description of Artificial Sequence: Synthetic oligonucleotide
cccagactctggccagagtctggg

SEQ ID NO: 391 - DNA, 24 bp, Artificial Sequence
  Description of Artificial Sequence: Synthetic oligonucleotide
ctcggactctggccagagtccgag

SEQ ID NO: 392 - DNA, 24 bp, Artificial Sequence
  Description of Artificial Sequence: Synthetic oligonucleotide
ccctgactctggccagagtcaggg

SEQ ID NO: 393 - DNA, 24 bp, Artificial Sequence
  Description of Artificial Sequence: Synthetic oligonucleotide
ccacgactctggccagagtcgtgg

SEQ ID NO: 394 - DNA, 24 bp, Artificial Sequence
  Description of Artificial Sequence: Synthetic oligonucleotide
agccgactctggccagagtcggct

SEQ ID NO: 395 - DNA, 24 bp, Artificial Sequence
  Description of Artificial Sequence: Synthetic oligonucleotide
tgccgactctggccagagtcggca

SEQ ID NO: 396 - DNA, 24 bp, Artificial Sequence
  Description of Artificial Sequence: Synthetic oligonucleotide
gcgagactctggccagagtctcgc

SEQ ID NO: 397 - DNA, 24 bp, Artificial Sequence
  Description of Artificial Sequence: Synthetic oligonucleotide
gcgtgactctggccagagtcacgc

SEQ ID NO: 398 - DNA, 24 bp, Artificial Sequence
  Description of Artificial Sequence: Synthetic oligonucleotide
gcaggactctggccagagtcctgc

SEQ ID NO: 399 - DNA, 24 bp, Artificial Sequence
  Description of Artificial Sequence: Synthetic oligonucleotide
gctggactctggccagagtccagc

SEQ ID NO: 400 - DNA, 24 bp, Artificial Sequence
  Description of Artificial Sequence: Synthetic oligonucleotide
cgaggactctggccagagtcctcg

SEQ ID NO: 401 - DNA, 24 bp, Artificial Sequence
  Description of Artificial Sequence: Synthetic oligonucleotide
cgtggactctggccagagtccacg

SEQ ID NO: 402 - DNA, 24 bp, Artificial Sequence
  Description of Artificial Sequence: Synthetic oligonucleotide
caccgactctggccagagtcggtg

SEQ ID NO: 403 - DNA, 24 bp, Artificial Sequence
  Description of Artificial Sequence: Synthetic oligonucleotide
ctccgactctggccagagtcggag

SEQ ID NO: 404 - DNA, 24 bp, Artificial Sequence
  Description of Artificial Sequence: Synthetic oligonucleotide
gcgggactctggccagagtcccgc

SEQ ID NO: 405 - DNA, 24 bp, Artificial Sequence
  Description of Artificial Sequence: Synthetic oligonucleotide
gagggactctggccagagtccctc

SEQ ID NO: 406 - DNA, 24 bp, Artificial Sequence
  Description of Artificial Sequence: Synthetic oligonucleotide
gtgggactctggccagagtcccac

SEQ ID NO: 407 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctgcgcagagtcnnnn

SEQ ID NO: 408 - DNA, 24 bp, Artificial Sequence
  Description of Artificial Sequence: Synthetic oligonucleotide
ggcggactctgcgcagagtccgcc

SEQ ID NO: 409 - DNA, 24 bp, Artificial Sequence
  Description of Artificial Sequence: Synthetic oligonucleotide
agcggactctgcgcagagtccgct

SEQ ID NO: 410 - DNA, 24 bp, Artificial Sequence
  Description of Artificial Sequence: Synthetic oligonucleotide
gacggactctgcgcagagtccgtc

SEQ ID NO: 411 - DNA, 24 bp, Artificial Sequence
  Description of Artificial Sequence: Synthetic oligonucleotide
ggaggactctgcgcagagtcctcc

SEQ ID NO: 412 - DNA, 24 bp, Artificial Sequence
  Description of Artificial Sequence: Synthetic oligonucleotide
ggcagactctgcgcagagtctgcc

SEQ ID NO: 413 - DNA, 24 bp, Artificial Sequence
  Description of Artificial Sequence: Synthetic oligonucleotide
tgcggactctgcgcagagtccgca

SEQ ID NO: 414 - DNA, 24 bp, Artificial Sequence
  Description of Artificial Sequence: Synthetic oligonucleotide
gtcggactctgcgcagagtccgac

SEQ ID NO: 415 - DNA, 24 bp, Artificial Sequence
  Description of Artificial Sequence: Synthetic oligonucleotide
ggtggactctgcgcagagtccacc

SEQ ID NO: 416 - DNA, 24 bp, Artificial Sequence
  Description of Artificial Sequence: Synthetic oligonucleotide
ggctgactctgcgcagagtcagcc

SEQ ID NO: 417 - DNA, 24 bp, Artificial Sequence
  Description of Artificial Sequence: Synthetic oligonucleotide
gcccgactctgcgcagagtcgggc

SEQ ID NO: 418 - DNA, 24 bp, Artificial Sequence
  Description of Artificial Sequence: Synthetic oligonucleotide
acccgactctgcgcagagtcgggt

SEQ ID NO: 419 - DNA, 24 bp, Artificial Sequence
  Description of Artificial Sequence: Synthetic oligonucleotide
gaccgactctgcgcagagtcggtc

SEQ ID NO: 420 - DNA, 24 bp, Artificial Sequence
  Description of Artificial Sequence: Synthetic oligonucleotide
gcacgactctgcgcagagtcgtgc

SEQ ID NO: 421 - DNA, 24 bp, Artificial Sequence
  Description of Artificial Sequence: Synthetic oligonucleotide
gccagactctgcgcagagtctggc

SEQ ID NO: 422 - DNA, 24 bp, Artificial Sequence
  Description of Artificial Sequence: Synthetic oligonucleotide
tcccgactctgcgcagagtcggga

SEQ ID NO: 423 - DNA, 24 bp, Artificial Sequence
  Description of Artificial Sequence: Synthetic oligonucleotide
gtccgactctgcgcagagtcggac

SEQ ID NO: 424 - DNA, 24 bp, Artificial Sequence
  Description of Artificial Sequence: Synthetic oligonucleotide
gcctgactctgcgcagagtcaggc

SEQ ID NO: 425 - DNA, 24 bp, Artificial Sequence
  Description of Artificial Sequence: Synthetic oligonucleotide
gggcgactctgcgcagagtcgccc

SEQ ID NO: 426 - DNA, 24 bp, Artificial Sequence
  Description of Artificial Sequence: Synthetic oligonucleotide
aggcgactctgcgcagagtcgcct

SEQ ID NO: 427 - DNA, 24 bp, Artificial Sequence
  Description of Artificial Sequence: Synthetic oligonucleotide
gagcgactctgcgcagagtcgctc

SEQ ID NO: 428 - DNA, 24 bp, Artificial Sequence
  Description of Artificial Sequence: Synthetic oligonucleotide
ggacgactctgcgcagagtcgtcc

SEQ ID NO: 429 - DNA, 24 bp, Artificial Sequence
  Description of Artificial Sequence: Synthetic oligonucleotide
gggagactctgcgcagagtctccc

SEQ ID NO: 430 - DNA, 24 bp, Artificial Sequence
  Description of Artificial Sequence: Synthetic oligonucleotide
tggcgactctgcgcagagtcgcca

SEQ ID NO: 431 - DNA, 24 bp, Artificial Sequence
  Description of Artificial Sequence: Synthetic oligonucleotide
gtgcgactctgcgcagagtcgcac

SEQ ID NO: 432 - DNA, 24 bp, Artificial Sequence
  Description of Artificial Sequence: Synthetic oligonucleotide
gggtgactctgcgcagagtcaccc

SEQ ID NO: 433 - DNA, 24 bp, Artificial Sequence
  Description of Artificial Sequence: Synthetic oligonucleotide
acgggactctgcgcagagtcccgt

SEQ ID NO: 434 - DNA, 24 bp, Artificial Sequence
  Description of Artificial Sequence: Synthetic oligonucleotide
cagggactctgcgcagagtccctg

SEQ ID NO: 435 - DNA, 24 bp, Artificial Sequence
  Description of Artificial Sequence: Synthetic oligonucleotide
ccaggactctgcgcagagtcctgg

SEQ ID NO: 436 - DNA, 24 bp, Artificial Sequence
  Description of Artificial Sequence: Synthetic oligonucleotide
ccgagactctgcgcagagtctcgg

SEQ ID NO: 437 - DNA, 24 bp, Artificial Sequence
  Description of Artificial Sequence: Synthetic oligonucleotide
tcgggactctgcgcagagtcccga

SEQ ID NO: 438 - DNA, 24 bp, Artificial Sequence
  Description of Artificial Sequence: Synthetic oligonucleotide
ctgggactctgcgcagagtcccag

SEQ ID NO: 439 - DNA, 24 bp, Artificial Sequence
  Description of Artificial Sequence: Synthetic oligonucleotide
cctggactctgcgcagagtccagg

SEQ ID NO: 440 - DNA, 24 bp, Artificial Sequence
  Description of Artificial Sequence: Synthetic oligonucleotide
ccgtgactctgcgcagagtcacgg

SEQ ID NO: 441 - DNA, 24 bp, Artificial Sequence
  Description of Artificial Sequence: Synthetic oligonucleotide
cggcgactctgcgcagagtcgccg

SEQ ID NO: 442 - DNA, 24 bp, Artificial Sequence
  Description of Artificial Sequence: Synthetic oligonucleotide
cagcgactctgcgcagagtcgctg

SEQ ID NO: 443 - DNA, 24 bp, Artificial Sequence
  Description of Artificial Sequence: Synthetic oligonucleotide
cgacgactctgcgcagagtcgtcg

SEQ ID NO: 444 - DNA, 24 bp, Artificial Sequence
  Description of Artificial Sequence: Synthetic oligonucleotide
cggagactctgcgcagagtctccg

SEQ ID NO: 445 - DNA, 24 bp, Artificial Sequence
  Description of Artificial Sequence: Synthetic oligonucleotide
ctgcgactctgcgcagagtcgcag

SEQ ID NO: 446 - DNA, 24 bp, Artificial Sequence
  Description of Artificial Sequence: Synthetic oligonucleotide
cggtgactctgcgcagagtcaccg

SEQ ID NO: 447 - DNA, 24 bp, Artificial Sequence
  Description of Artificial Sequence: Synthetic oligonucleotide
cacggactctgcgcagagtccgtg

SEQ ID NO: 448 - DNA, 24 bp, Artificial Sequence
  Description of Artificial Sequence: Synthetic oligonucleotide
cccagactctgcgcagagtctggg

SEQ ID NO: 449 - DNA, 24 bp, Artificial Sequence
  Description of Artificial Sequence: Synthetic oligonucleotide
ctcggactctgcgcagagtccgag

SEQ ID NO: 450 - DNA, 24 bp, Artificial Sequence
  Description of Artificial Sequence: Synthetic oligonucleotide
ccctgactctgcgcagagtcaggg

SEQ ID NO: 451 - DNA, 24 bp, Artificial Sequence
  Description of Artificial Sequence: Synthetic oligonucleotide
ccacgactctgcgcagagtcgtgg

SEQ ID NO: 452 - DNA, 24 bp, Artificial Sequence
  Description of Artificial Sequence: Synthetic oligonucleotide
agccgactctgcgcagagtcggct

SEQ ID NO: 453 - DNA, 24 bp, Artificial Sequence
  Description of Artificial Sequence: Synthetic oligonucleotide
tgccgactctgcgcagagtcggca

SEQ ID NO: 454 - DNA, 24 bp, Artificial Sequence
  Description of Artificial Sequence: Synthetic oligonucleotide
gcgagactctgcgcagagtctcgc

SEQ ID NO: 455 - DNA, 24 bp, Artificial Sequence
  Description of Artificial Sequence: Synthetic oligonucleotide
gcgtgactctgcgcagagtcacgc

SEQ ID NO: 456 - DNA, 24 bp, Artificial Sequence
  Description of Artificial Sequence: Synthetic oligonucleotide
gcaggactctgcgcagagtcctgc

SEQ ID NO: 457 - DNA, 24 bp, Artificial Sequence
  Description of Artificial Sequence: Synthetic oligonucleotide
gctggactctgcgcagagtccagc

SEQ ID NO: 458 - DNA, 24 bp, Artificial Sequence
  Description of Artificial Sequence: Synthetic oligonucleotide
cgaggactctgcgcagagtcctcg

SEQ ID NO: 459 - DNA, 24 bp, Artificial Sequence
  Description of Artificial Sequence: Synthetic oligonucleotide
cgtggactctgcgcagagtccacg

SEQ ID NO: 460 - DNA, 24 bp, Artificial Sequence
  Description of Artificial Sequence: Synthetic oligonucleotide
caccgactctgcgcagagtcggtg

SEQ ID NO: 461 - DNA, 24 bp, Artificial Sequence
  Description of Artificial Sequence: Synthetic oligonucleotide
ctccgactctgcgcagagtcggag

SEQ ID NO: 462 - DNA, 24 bp, Artificial Sequence
  Description of Artificial Sequence: Synthetic oligonucleotide
gcgggactctgcgcagagtcccgc

SEQ ID NO: 463 - DNA, 24 bp, Artificial Sequence
  Description of Artificial Sequence: Synthetic oligonucleotide
gagggactctgcgcagagtccctc

SEQ ID NO: 464 - DNA, 24 bp, Artificial Sequence
  Description of Artificial Sequence: Synthetic oligonucleotide
gtgggactctgcgcagagtcccac

SEQ ID NO: 465 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgcatgcgagtcnnnn

SEQ ID NO: 466 - DNA, 24 bp, Artificial Sequence
  Description of Artificial Sequence: Synthetic oligonucleotide
ggcggactcgcatgcgagtccgcc

SEQ ID NO: 467 - DNA, 24 bp, Artificial Sequence
  Description of Artificial Sequence: Synthetic oligonucleotide
agcggactcgcatgcgagtccgct

SEQ ID NO: 468 - DNA, 24 bp, Artificial Sequence
  Description of Artificial Sequence: Synthetic oligonucleotide
gacggactcgcatgcgagtccgtc

SEQ ID NO: 469 - DNA, 24 bp, Artificial Sequence
  Description of Artificial Sequence: Synthetic oligonucleotide
ggaggactcgcatgcgagtcctcc

SEQ ID NO: 470 - DNA, 24 bp, Artificial Sequence
  Description of Artificial Sequence: Synthetic oligonucleotide
ggcagactcgcatgcgagtctgcc

SEQ ID NO: 471 - DNA, 24 bp, Artificial Sequence
  Description of Artificial Sequence: Synthetic oligonucleotide
tgcggactcgcatgcgagtccgca

SEQ ID NO: 472 - DNA, 24 bp, Artificial Sequence
  Description of Artificial Sequence: Synthetic oligonucleotide
gtcggactcgcatgcgagtccgac

SEQ ID NO: 473 - DNA, 24 bp, Artificial Sequence
  Description of Artificial Sequence: Synthetic oligonucleotide
ggtggactcgcatgcgagtccacc

SEQ ID NO: 474 - DNA, 24 bp, Artificial Sequence
  Description of Artificial Sequence: Synthetic oligonucleotide
ggctgactcgcatgcgagtcagcc

SEQ ID NO: 475 - DNA, 24 bp, Artificial Sequence
  Description of Artificial Sequence: Synthetic oligonucleotide
gcccgactcgcatgcgagtcgggc

SEQ ID NO: 476 - DNA, 24 bp, Artificial Sequence
  Description of Artificial Sequence: Synthetic oligonucleotide
acccgactcgcatgcgagtcgggt

SEQ ID NO: 477 - DNA, 24 bp, Artificial Sequence
  Description of Artificial Sequence: Synthetic oligonucleotide
gaccgactcgcatgcgagtcggtc

SEQ ID NO: 478 - DNA, 24 bp, Artificial Sequence
  Description of Artificial Sequence: Synthetic oligonucleotide
gcacgactcgcatgcgagtcgtgc

SEQ ID NO: 479 - DNA, 24 bp, Artificial Sequence
  Description of Artificial Sequence: Synthetic oligonucleotide
gccagactcgcatgcgagtctggc

SEQ ID NO: 480 - DNA, 24 bp, Artificial Sequence
  Description of Artificial Sequence: Synthetic oligonucleotide
tcccgactcgcatgcgagtcggga

SEQ ID NO: 481 - DNA, 24 bp, Artificial Sequence
  Description of Artificial Sequence: Synthetic oligonucleotide
gtccgactcgcatgcgagtcggac

SEQ ID NO: 482 - DNA, 24 bp, Artificial Sequence
  Description of Artificial Sequence: Synthetic oligonucleotide
gcctgactcgcatgcgagtcaggc

SEQ ID NO: 483 - DNA, 24 bp, Artificial Sequence
  Description of Artificial Sequence: Synthetic oligonucleotide
gggcgactcgcatgcgagtcgccc

SEQ ID NO: 484 - DNA, 24 bp, Artificial Sequence
  Description of Artificial Sequence: Synthetic oligonucleotide
aggcgactcgcatgcgagtcgcct

SEQ ID NO: 485 - DNA, 24 bp, Artificial Sequence
  Description of Artificial Sequence: Synthetic oligonucleotide
gagcgactcgcatgcgagtcgctc

SEQ ID NO: 486 - DNA, 24 bp, Artificial Sequence
  Description of Artificial Sequence: Synthetic oligonucleotide
ggacgactcgcatgcgagtcgtcc

SEQ ID NO: 487 - DNA, 24 bp, Artificial Sequence
  Description of Artificial Sequence: Synthetic oligonucleotide
gggagactcgcatgcgagtctccc

SEQ ID NO: 488 - DNA, 24 bp, Artificial Sequence
  Description of Artificial Sequence: Synthetic oligonucleotide
tggcgactcgcatgcgagtcgcca

SEQ ID NO: 489 - DNA, 24 bp, Artificial Sequence
  Description of Artificial Sequence: Synthetic oligonucleotide
gtgcgactcgcatgcgagtcgcac

SEQ ID NO: 490 - DNA, 24 bp, Artificial Sequence
  Description of Artificial Sequence: Synthetic oligonucleotide
gggtgactcgcatgcgagtcaccc

SEQ ID NO: 491 - DNA, 24 bp, Artificial Sequence
  Description of Artificial Sequence: Synthetic oligonucleotide
acgggactcgcatgcgagtcccgt

SEQ ID NO: 492 - DNA, 24 bp, Artificial Sequence
  Description of Artificial Sequence: Synthetic oligonucleotide
cagggactcgcatgcgagtccctg

SEQ ID NO: 493 - DNA, 24 bp, Artificial Sequence
  Description of Artificial Sequence: Synthetic oligonucleotide
ccaggactcgcatgcgagtcctgg

SEQ ID NO: 494 - DNA, 24 bp, Artificial Sequence
  Description of Artificial Sequence: Synthetic oligonucleotide
ccgagactcgcatgcgagtctcgg

SEQ ID NO: 495 - DNA, 24 bp, Artificial Sequence
  Description of Artificial Sequence: Synthetic oligonucleotide
tcgggactcgcatgcgagtcccga

SEQ ID NO: 496 - DNA, 24 bp, Artificial Sequence
  Description of Artificial Sequence: Synthetic oligonucleotide
ctgggactcgcatgcgagtcccag

SEQ ID NO: 497 - DNA, 24 bp, Artificial Sequence
  Description of Artificial Sequence: Synthetic oligonucleotide
cctggactcgcatgcgagtccagg

SEQ ID NO: 498 - DNA, 24 bp, Artificial Sequence
  Description of Artificial Sequence: Synthetic oligonucleotide
ccgtgactcgcatgcgagtcacgg

SEQ ID NO: 499 - DNA, 24 bp, Artificial Sequence
  Description of Artificial Sequence: Synthetic oligonucleotide
cggcgactcgcatgcgagtcgccg

SEQ ID NO: 500 - DNA, 24 bp, Artificial Sequence
  Description of Artificial Sequence: Synthetic oligonucleotide
cagcgactcgcatgcgagtcgctg

SEQ ID NO: 501 - DNA, 24 bp, Artificial Sequence
  Description of Artificial Sequence: Synthetic oligonucleotide
cgacgactcgcatgcgagtcgtcg

SEQ ID NO: 502 - DNA, 24 bp, Artificial Sequence
  Description of Artificial Sequence: Synthetic oligonucleotide
cggagactcgcatgcgagtctccg

SEQ ID NO: 503 - DNA, 24 bp, Artificial Sequence
  Description of Artificial Sequence: Synthetic oligonucleotide
ctgcgactcgcatgcgagtcgcag

SEQ ID NO: 504 - DNA, 24 bp, Artificial Sequence
  Description of Artificial Sequence: Synthetic oligonucleotide
cggtgactcgcatgcgagtcaccg

SEQ ID NO: 505 - DNA, 24 bp, Artificial Sequence
  Description of Artificial Sequence: Synthetic oligonucleotide
cacggactcgcatgcgagtccgtg

SEQ ID NO: 506 - DNA, 24 bp, Artificial Sequence
  Description of Artificial Sequence: Synthetic oligonucleotide
cccagactcgcatgcgagtctggg

SEQ ID NO: 507 - DNA, 24 bp, Artificial Sequence
  Description of Artificial Sequence: Synthetic oligonucleotide
ctcggactcgcatgcgagtccgag

SEQ ID NO: 508 - DNA, 24 bp, Artificial Sequence
  Description of Artificial Sequence: Synthetic oligonucleotide
ccctgactcgcatgcgagtcaggg

SEQ ID NO: 509 - DNA, 24 bp, Artificial Sequence
  Description of Artificial Sequence: Synthetic oligonucleotide
ccacgactcgcatgcgagtcgtgg

SEQ ID NO: 510 - DNA, 24 bp, Artificial Sequence
  Description of Artificial Sequence: Synthetic oligonucleotide
agccgactcgcatgcgagtcggct

SEQ ID NO: 511 - DNA, 24 bp, Artificial Sequence
  Description of Artificial Sequence: Synthetic oligonucleotide
tgccgactcgcatgcgagtcggca

SEQ ID NO: 512 - DNA, 24 bp, Artificial Sequence
  Description of Artificial Sequence: Synthetic oligonucleotide
gcgagactcgcatgcgagtctcgc

SEQ ID NO: 513 - DNA, 24 bp, Artificial Sequence
  Description of Artificial Sequence: Synthetic oligonucleotide
gcgtgactcgcatgcgagtcacgc

SEQ ID NO: 514 - DNA, 24 bp, Artificial Sequence
  Description of Artificial Sequence: Synthetic oligonucleotide
gcaggactcgcatgcgagtcctgc

SEQ ID NO: 515 - DNA, 24 bp, Artificial Sequence
  Description of Artificial Sequence: Synthetic oligonucleotide
gctggactcgcatgcgagtccagc

SEQ ID NO: 516 - DNA, 24 bp, Artificial Sequence
  Description of Artificial Sequence: Synthetic oligonucleotide
cgaggactcgcatgcgagtcctcg

SEQ ID NO: 517 - DNA, 24 bp, Artificial Sequence
  Description of Artificial Sequence: Synthetic oligonucleotide
cgtggactcgcatgcgagtccacg

SEQ ID NO: 518 - DNA, 24 bp, Artificial Sequence
  Description of Artificial Sequence: Synthetic oligonucleotide
caccgactcgcatgcgagtcggtg

SEQ ID NO: 519 - DNA, 24 bp, Artificial Sequence
  Description of Artificial Sequence: Synthetic oligonucleotide
ctccgactcgcatgcgagtcggag

SEQ ID NO: 520 - DNA, 24 bp, Artificial Sequence
  Description of Artificial Sequence: Synthetic oligonucleotide
gcgggactcgcatgcgagtcccgc

SEQ ID NO: 521 - DNA, 24 bp, Artificial Sequence
  Description of Artificial Sequence: Synthetic oligonucleotide
gagggactcgcatgcgagtccctc

SEQ ID NO: 522 - DNA, 24 bp, Artificial Sequence
  Description of Artificial Sequence: Synthetic oligonucleotide
gtgggactcgcatgcgagtcccac

SEQ ID NO: 523 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgctagcgagtcnnnn

SEQ ID NO: 524 - DNA, 24 bp, Artificial Sequence
  Description of Artificial Sequence: Synthetic oligonucleotide
ggcggactcgctagcgagtccgcc

SEQ ID NO: 525 - DNA, 24 bp, Artificial Sequence
  Description of Artificial Sequence: Synthetic oligonucleotide
agcggactcgctagcgagtccgct

SEQ ID NO: 526 - DNA, 24 bp, Artificial Sequence
  Description of Artificial Sequence: Synthetic oligonucleotide
gacggactcgctagcgagtccgtc

SEQ ID NO: 527 - DNA, 24 bp, Artificial Sequence
  Description of Artificial Sequence: Synthetic oligonucleotide
ggaggactcgctagcgagtcctcc

SEQ ID NO: 528 - DNA, 24 bp, Artificial Sequence
  Description of Artificial Sequence: Synthetic oligonucleotide
ggcagactcgctagcgagtctgcc

SEQ ID NO: 529 - DNA, 24 bp, Artificial Sequence
  Description of Artificial Sequence: Synthetic oligonucleotide
tgcggactcgctagcgagtccgca

SEQ ID NO: 530 - DNA, 24 bp, Artificial Sequence
  Description of Artificial Sequence: Synthetic oligonucleotide
gtcggactcgctagcgagtccgac

SEQ ID NO: 531 - DNA, 24 bp, Artificial Sequence
  Description of Artificial Sequence: Synthetic oligonucleotide
ggtggactcgctagcgagtccacc

SEQ ID NO: 532 - DNA, 24 bp, Artificial Sequence
  Description of Artificial Sequence: Synthetic oligonucleotide
ggctgactcgctagcgagtcagcc

SEQ ID NO: 533 - DNA, 24 bp, Artificial Sequence
  Description of Artificial Sequence: Synthetic oligonucleotide
gcccgactcgctagcgagtcgggc

SEQ ID NO: 534 - DNA, 24 bp, Artificial Sequence
  Description of Artificial Sequence: Synthetic oligonucleotide
acccgactcgctagcgagtcgggt

SEQ ID NO: 535 - DNA, 24 bp, Artificial Sequence
  Description of Artificial Sequence: Synthetic oligonucleotide
gaccgactcgctagcgagtcggtc

SEQ ID NO: 536 - DNA, 24 bp, Artificial Sequence
  Description of Artificial Sequence: Synthetic oligonucleotide
gcacgactcgctagcgagtcgtgc

SEQ ID NO: 537 - DNA, 24 bp, Artificial Sequence
  Description of Artificial Sequence: Synthetic oligonucleotide
gccagactcgctagcgagtctggc

SEQ ID NO: 538 - DNA, 24 bp, Artificial Sequence
  Description of Artificial Sequence: Synthetic oligonucleotide
tcccgactcgctagcgagtcggga

SEQ ID NO: 539 - DNA, 24 bp, Artificial Sequence
  Description of Artificial Sequence: Synthetic oligonucleotide
gtccgactcgctagcgagtcggac

SEQ ID NO: 540 - DNA, 24 bp, Artificial Sequence
  Description of Artificial Sequence: Synthetic oligonucleotide
gcctgactcgctagcgagtcaggc

SEQ ID NO: 541 - DNA, 24 bp, Artificial Sequence
  Description of Artificial Sequence: Synthetic oligonucleotide
gggcgactcgctagcgagtcgccc

SEQ ID NO: 542 - DNA, 24 bp, Artificial Sequence
  Description of Artificial Sequence: Synthetic oligonucleotide
aggcgactcgctagcgagtcgcct

SEQ ID NO: 543 - DNA, 24 bp, Artificial Sequence
  Description of Artificial Sequence: Synthetic oligonucleotide
gagcgactcgctagcgagtcgctc

SEQ ID NO: 544 - DNA, 24 bp, Artificial Sequence
  Description of Artificial Sequence: Synthetic oligonucleotide
ggacgactcgctagcgagtcgtcc

SEQ ID NO: 545 - DNA, 24 bp, Artificial Sequence
  Description of Artificial Sequence: Synthetic oligonucleotide
gggagactcgctagcgagtctccc

SEQ ID NO: 546 - DNA, 24 bp, Artificial Sequence
  Description of Artificial Sequence: Synthetic oligonucleotide
tggcgactcgctagcgagtcgcca

SEQ ID NO: 547 - DNA, 24 bp, Artificial Sequence
  Description of Artificial Sequence: Synthetic oligonucleotide
gtgcgactcgctagcgagtcgcac

SEQ ID NO: 548 - DNA, 24 bp, Artificial Sequence
  Description of Artificial Sequence: Synthetic oligonucleotide
gggtgactcgctagcgagtcaccc

SEQ ID NO: 549 - DNA, 24 bp, Artificial Sequence
  Description of Artificial Sequence: Synthetic oligonucleotide
acgggactcgctagcgagtcccgt

SEQ ID NO: 550 - DNA, 24 bp, Artificial Sequence
  Description of Artificial Sequence: Synthetic oligonucleotide
cagggactcgctagcgagtccctg

SEQ ID NO: 551 - DNA, 24 bp, Artificial Sequence
  Description of Artificial Sequence: Synthetic oligonucleotide
ccaggactcgctagcgagtcctgg

SEQ ID NO: 552 - DNA, 24 bp, Artificial Sequence
  Description of Artificial Sequence: Synthetic oligonucleotide
ccgagactcgctagcgagtctcgg

SEQ ID NO: 553 - DNA, 24 bp, Artificial Sequence
  Description of Artificial Sequence: Synthetic oligonucleotide
tcgggactcgctagcgagtcccga

SEQ ID NO: 554 - DNA, 24 bp, Artificial Sequence
  Description of Artificial Sequence: Synthetic oligonucleotide
ctgggactcgctagcgagtcccag

SEQ ID NO: 555 - DNA, 24 bp, Artificial Sequence
  Description of Artificial Sequence: Synthetic oligonucleotide
cctggactcgctagcgagtccagg

SEQ ID NO: 556 - DNA, 24 bp, Artificial Sequence
  Description of Artificial Sequence: Synthetic oligonucleotide
ccgtgactcgctagcgagtcacgg

SEQ ID NO: 557 - DNA, 24 bp, Artificial Sequence
  Description of Artificial Sequence: Synthetic oligonucleotide
cggcgactcgctagcgagtcgccg

SEQ ID NO: 558 - DNA, 24 bp, Artificial Sequence
  Description of Artificial Sequence: Synthetic oligonucleotide
cagcgactcgctagcgagtcgctg

SEQ ID NO: 559 - DNA, 24 bp, Artificial Sequence
  Description of Artificial Sequence: Synthetic oligonucleotide
cgacgactcgctagcgagtcgtcg

SEQ ID NO: 560 - DNA, 24 bp, Artificial Sequence
  Description of Artificial Sequence: Synthetic oligonucleotide
cggagactcgctagcgagtctccg

SEQ ID NO: 561 - DNA, 24 bp, Artificial Sequence
  Description of Artificial Sequence: Synthetic oligonucleotide
ctgcgactcgctagcgagtcgcag

SEQ ID NO: 562 - DNA, 24 bp, Artificial Sequence
  Description of Artificial Sequence: Synthetic oligonucleotide
cggtgactcgctagcgagtcaccg

SEQ ID NO: 563 - DNA, 24 bp, Artificial Sequence
  Description of Artificial Sequence: Synthetic oligonucleotide
cacggactcgctagcgagtccgtg

SEQ ID NO: 564 - DNA, 24 bp, Artificial Sequence
  Description of Artificial Sequence: Synthetic oligonucleotide
cccagactcgctagcgagtctggg

SEQ ID NO: 565 - DNA, 24 bp, Artificial Sequence
  Description of Artificial Sequence: Synthetic oligonucleotide
ctcggactcgctagcgagtccgag

SEQ ID NO: 566 - DNA, 24 bp, Artificial Sequence
  Description of Artificial Sequence: Synthetic oligonucleotide
ccctgactcgctagcgagtcaggg

SEQ ID NO: 567 - DNA, 24 bp, Artificial Sequence
  Description of Artificial Sequence: Synthetic oligonucleotide
ccacgactcgctagcgagtcgtgg

SEQ ID NO: 568 - DNA, 24 bp, Artificial Sequence
  Description of Artificial Sequence: Synthetic oligonucleotide
agccgactcgctagcgagtcggct

SEQ ID NO: 569 - DNA, 24 bp, Artificial Sequence
  Description of Artificial Sequence: Synthetic oligonucleotide
tgccgactcgctagcgagtcggca

SEQ ID NO: 570 - DNA, 24 bp, Artificial Sequence
  Description of Artificial Sequence: Synthetic oligonucleotide
gcgagactcgctagcgagtctcgc

SEQ ID NO: 571 - DNA, 24 bp, Artificial Sequence
  Description of Artificial Sequence: Synthetic oligonucleotide
gcgtgactcgctagcgagtcacgc

SEQ ID NO: 572 - DNA, 24 bp, Artificial Sequence
  Description of Artificial Sequence: Synthetic oligonucleotide
gcaggactcgctagcgagtcctgc

SEQ ID NO: 573 - DNA, 24 bp, Artificial Sequence
  Description of Artificial Sequence: Synthetic oligonucleotide
gctggactcgctagcgagtccagc

SEQ ID NO: 574 - DNA, 24 bp, Artificial Sequence
  Description of Artificial Sequence: Synthetic oligonucleotide
cgaggactcgctagcgagtcctcg

SEQ ID NO: 575 - DNA, 24 bp, Artificial Sequence
  Description of Artificial Sequence: Synthetic oligonucleotide
cgtggactcgctagcgagtccacg

SEQ ID NO: 576 - DNA, 24 bp, Artificial Sequence
  Description of Artificial Sequence: Synthetic oligonucleotide
caccgactcgctagcgagtcggtg

SEQ ID NO: 577 - DNA, 24 bp, Artificial Sequence
  Description of Artificial Sequence: Synthetic oligonucleotide
ctccgactcgctagcgagtcggag

SEQ ID NO: 578 - DNA, 24 bp, Artificial Sequence
  Description of Artificial Sequence: Synthetic oligonucleotide
gcgggactcgctagcgagtcccgc

SEQ ID NO: 579 - DNA, 24 bp, Artificial Sequence
  Description of Artificial Sequence: Synthetic oligonucleotide
gagggactcgctagcgagtccctc

SEQ ID NO: 580 - DNA, 24 bp, Artificial Sequence
  Description of Artificial Sequence: Synthetic oligonucleotide
gtgggactcgctagcgagtcccac

SEQ ID NO: 581 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgcgcgcgagtcnnnn

SEQ ID NO: 582 - DNA, 24 bp, Artificial Sequence
  Description of Artificial Sequence: Synthetic oligonucleotide
ggcggactcgcgcgcgagtccgcc

SEQ ID NO: 583 - DNA, 24 bp, Artificial Sequence
  Description of Artificial Sequence: Synthetic oligonucleotide
agcggactcgcgcgcgagtccgct

SEQ ID NO: 584 - DNA, 24 bp, Artificial Sequence
  Description of Artificial Sequence: Synthetic oligonucleotide
gacggactcgcgcgcgagtccgtc

SEQ ID NO: 585 - DNA, 24 bp, Artificial Sequence
  Description of Artificial Sequence: Synthetic oligonucleotide
ggaggactcgcgcgcgagtcctcc

SEQ ID NO: 586 - DNA, 24 bp, Artificial Sequence
  Description of Artificial Sequence: Synthetic oligonucleotide
ggcagactcgcgcgcgagtctgcc

SEQ ID NO: 587 - DNA, 24 bp, Artificial Sequence
  Description of Artificial Sequence: Synthetic oligonucleotide
tgcggactcgcgcgcgagtccgca

SEQ ID NO: 588 - DNA, 24 bp, Artificial Sequence
  Description of Artificial Sequence: Synthetic oligonucleotide
gtcggactcgcgcgcgagtccgac

SEQ ID NO: 589 - DNA, 24 bp, Artificial Sequence
  Description of Artificial Sequence: Synthetic oligonucleotide
ggtggactcgcgcgcgagtccacc

SEQ ID NO: 590 - DNA, 24 bp, Artificial Sequence
  Description of Artificial Sequence: Synthetic oligonucleotide
ggctgactcgcgcgcgagtcagcc

SEQ ID NO: 591 - DNA, 24 bp, Artificial Sequence
  Description of Artificial Sequence: Synthetic oligonucleotide
gcccgactcgcgcgcgagtcgggc

SEQ ID NO: 592 - DNA, 24 bp, Artificial Sequence
  Description of Artificial Sequence: Synthetic oligonucleotide
acccgactcgcgcgcgagtcgggt

SEQ ID NO: 593 - DNA, 24 bp, Artificial Sequence
  Description of Artificial Sequence: Synthetic oligonucleotide
gaccgactcgcgcgcgagtcggtc

SEQ ID NO: 594 - DNA, 24 bp, Artificial Sequence
  Description of Artificial Sequence: Synthetic oligonucleotide
gcacgactcgcgcgcgagtcgtgc

SEQ ID NO: 595 - DNA, 24 bp, Artificial Sequence
  Description of Artificial Sequence: Synthetic oligonucleotide
gccagactcgcgcgcgagtctggc

SEQ ID NO: 596 - DNA, 24 bp, Artificial Sequence
  Description of Artificial Sequence: Synthetic oligonucleotide
tcccgactcgcgcgcgagtcggga

SEQ ID NO: 597 - DNA, 24 bp, Artificial Sequence
  Description of Artificial Sequence: Synthetic oligonucleotide
gtccgactcgcgcgcgagtcggac

SEQ ID NO: 598 - DNA, 24 bp, Artificial Sequence
  Description of Artificial Sequence: Synthetic oligonucleotide
gcctgactcgcgcgcgagtcaggc

SEQ ID NO: 599 - DNA, 24 bp, Artificial Sequence
  Description of Artificial Sequence: Synthetic oligonucleotide
gggcgactcgcgcgcgagtcgccc

SEQ ID NO: 600 - DNA, 24 bp, Artificial Sequence
  Description of Artificial Sequence: Synthetic oligonucleotide
aggcgactcgcgcgcgagtcgcct

SEQ ID NO: 601 - DNA, 24 bp, Artificial Sequence
  Description of Artificial Sequence: Synthetic oligonucleotide
gagcgactcgcgcgcgagtcgctc

SEQ ID NO: 602 - DNA, 24 bp, Artificial Sequence
  Description of Artificial Sequence: Synthetic oligonucleotide
ggacgactcgcgcgcgagtcgtcc

SEQ ID NO: 603 - DNA, 24 bp, Artificial Sequence
  Description of Artificial Sequence: Synthetic oligonucleotide
gggagactcgcgcgcgagtctccc

SEQ ID NO: 604 - DNA, 24 bp, Artificial Sequence
  Description of Artificial Sequence: Synthetic oligonucleotide
tggcgactcgcgcgcgagtcgcca

SEQ ID NO: 605 - DNA, 24 bp, Artificial Sequence
  Description of Artificial Sequence: Synthetic oligonucleotide
gtgcgactcgcgcgcgagtcgcac

SEQ ID NO: 606 - DNA, 24 bp, Artificial Sequence
  Description of Artificial Sequence: Synthetic oligonucleotide
gggtgactcgcgcgcgagtcaccc

SEQ ID NO: 607 - DNA, 24 bp, Artificial Sequence
  Description of Artificial Sequence: Synthetic oligonucleotide
acgggactcgcgcgcgagtcccgt

SEQ ID NO: 608 - DNA, 24 bp, Artificial Sequence
  Description of Artificial Sequence: Synthetic oligonucleotide
cagggactcgcgcgcgagtccctg

SEQ ID NO: 609 - DNA, 24 bp, Artificial Sequence
  Description of Artificial Sequence: Synthetic oligonucleotide
ccaggactcgcgcgcgagtcctgg

SEQ ID NO: 610 - DNA, 24 bp, Artificial Sequence
  Description of Artificial Sequence: Synthetic oligonucleotide
ccgagactcgcgcgcgagtctcgg

SEQ ID NO: 611 - DNA, 24 bp, Artificial Sequence
  Description of Artificial Sequence: Synthetic oligonucleotide
tcgggactcgcgcgcgagtcccga

SEQ ID NO: 612 - DNA, 24 bp, Artificial Sequence
  Description of Artificial Sequence: Synthetic oligonucleotide
ctgggactcgcgcgcgagtcccag

SEQ ID NO: 613 - DNA, 24 bp, Artificial Sequence
  Description of Artificial Sequence: Synthetic oligonucleotide
cctggactcgcgcgcgagtccagg

SEQ ID NO: 614 - DNA, 24 bp, Artificial Sequence
  Description of Artificial Sequence: Synthetic oligonucleotide
ccgtgactcgcgcgcgagtcacgg

SEQ ID NO: 615 - DNA, 24 bp, Artificial Sequence
  Description of Artificial Sequence: Synthetic oligonucleotide
cggcgactcgcgcgcgagtcgccg

SEQ ID NO: 616 - DNA, 24 bp, Artificial Sequence
  Description of Artificial Sequence: Synthetic oligonucleotide
cagcgactcgcgcgcgagtcgctg

SEQ ID NO: 617 - DNA, 24 bp, Artificial Sequence
  Description of Artificial Sequence: Synthetic oligonucleotide
cgacgactcgcgcgcgagtcgtcg

SEQ ID NO: 618 - DNA, 24 bp, Artificial Sequence
  Description of Artificial Sequence: Synthetic oligonucleotide
cggagactcgcgcgcgagtctccg

SEQ ID NO: 619 - DNA, 24 bp, Artificial Sequence
  Description of Artificial Sequence: Synthetic oligonucleotide
ctgcgactcgcgcgcgagtcgcag

SEQ ID NO: 620 - DNA, 24 bp, Artificial Sequence
  Description of Artificial Sequence: Synthetic oligonucleotide
cggtgactcgcgcgcgagtcaccg

SEQ ID NO: 621 - DNA, 24 bp, Artificial Sequence
  Description of Artificial Sequence: Synthetic oligonucleotide
cacggactcgcgcgcgagtccgtg

SEQ ID NO: 622 - DNA, 24 bp, Artificial Sequence
  Description of Artificial Sequence: Synthetic oligonucleotide
cccagactcgcgcgcgagtctggg

SEQ ID NO: 623 - DNA, 24 bp, Artificial Sequence
  Description of Artificial Sequence: Synthetic oligonucleotide
ctcggactcgcgcgcgagtccgag

SEQ ID NO: 624 - DNA, 24 bp, Artificial Sequence
  Description of Artificial Sequence: Synthetic oligonucleotide
ccctgactcgcgcgcgagtcaggg

SEQ ID NO: 625 - DNA, 24 bp, Artificial Sequence
  Description of Artificial Sequence: Synthetic oligonucleotide
ccacgactcgcgcgcgagtcgtgg

SEQ ID NO: 626 - DNA, 24 bp, Artificial Sequence
  Description of Artificial Sequence: Synthetic oligonucleotide
agccgactcgcgcgcgagtcggct

SEQ ID NO: 627 - DNA, 24 bp, Artificial Sequence
  Description of Artificial Sequence: Synthetic oligonucleotide
tgccgactcgcgcgcgagtcggca

SEQ ID NO: 628 - DNA, 24 bp, Artificial Sequence
  Description of Artificial Sequence: Synthetic oligonucleotide
gcgagactcgcgcgcgagtctcgc

SEQ ID NO: 629 - DNA, 24 bp, Artificial Sequence
  Description of Artificial Sequence: Synthetic oligonucleotide
gcgtgactcgcgcgcgagtcacgc

SEQ ID NO: 630 - DNA, 24 bp, Artificial Sequence
  Description of Artificial Sequence: Synthetic oligonucleotide
gcaggactcgcgcgcgagtcctgc

SEQ ID NO: 631 - DNA, 24 bp, Artificial Sequence
  Description of Artificial Sequence: Synthetic oligonucleotide
gctggactcgcgcgcgagtccagc

SEQ ID NO: 632 - DNA, 24 bp, Artificial Sequence
  Description of Artificial Sequence: Synthetic oligonucleotide
cgaggactcgcgcgcgagtcctcg

SEQ ID NO: 633 - DNA, 24 bp, Artificial Sequence
  Description of Artificial Sequence: Synthetic oligonucleotide
cgtggactcgcgcgcgagtccacg

SEQ ID NO: 634 - DNA, 24 bp, Artificial Sequence
  Description of Artificial Sequence: Synthetic oligonucleotide
caccgactcgcgcgcgagtcggtg

SEQ ID NO: 635 - DNA, 24 bp, Artificial Sequence
  Description of Artificial Sequence: Synthetic oligonucleotide
ctccgactcgcgcgcgagtcggag

SEQ ID NO: 636 - DNA, 24 bp, Artificial Sequence
  Description of Artificial Sequence: Synthetic oligonucleotide
gcgggactcgcgcgcgagtcccgc

SEQ ID NO: 637 - DNA, 24 bp, Artificial Sequence
  Description of Artificial Sequence: Synthetic oligonucleotide
gagggactcgcgcgcgagtccctc

SEQ ID NO: 638 - DNA, 24 bp, Artificial Sequence
  Description of Artificial Sequence: Synthetic oligonucleotide
gtgggactcgcgcgcgagtcccac

SEQ ID NO: 639 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgccggcgagtcnnnn

SEQ ID NO: 640 - DNA, 24 bp, Artificial Sequence
  Description of Artificial Sequence: Synthetic oligonucleotide
ggcggactcgccggcgagtccgcc

SEQ ID NO: 641 - DNA, 24 bp, Artificial Sequence
  Description of Artificial Sequence: Synthetic oligonucleotide
agcggactcgccggcgagtccgct

SEQ ID NO: 642 - DNA, 24 bp, Artificial Sequence
  Description of Artificial Sequence: Synthetic oligonucleotide
gacggactcgccggcgagtccgtc

SEQ ID NO: 643 - DNA, 24 bp, Artificial Sequence
  Description of Artificial Sequence: Synthetic oligonucleotide
ggaggactcgccggcgagtcctcc

SEQ ID NO: 644 - DNA, 24 bp, Artificial Sequence
  Description of Artificial Sequence: Synthetic oligonucleotide
ggcagactcgccggcgagtctgcc

SEQ ID NO: 645 - DNA, 24 bp, Artificial Sequence
  Description of Artificial Sequence: Synthetic oligonucleotide
tgcggactcgccggcgagtccgca

SEQ ID NO: 646 - DNA, 24 bp, Artificial Sequence
  Description of Artificial Sequence: Synthetic oligonucleotide
gtcggactcgccggcgagtccgac

SEQ ID NO: 647 - DNA, 24 bp, Artificial Sequence
  Description of Artificial Sequence: Synthetic oligonucleotide
ggtggactcgccggcgagtccacc

SEQ ID NO: 648 - DNA, 24 bp, Artificial Sequence
  Description of Artificial Sequence: Synthetic oligonucleotide
ggctgactcgccggcgagtcagcc

SEQ ID NO: 649 - DNA, 24 bp, Artificial Sequence
  Description of Artificial Sequence: Synthetic oligonucleotide
gcccgactcgccggcgagtcgggc

SEQ ID NO: 650 - DNA, 24 bp, Artificial Sequence
  Description of Artificial Sequence: Synthetic oligonucleotide
acccgactcgccggcgagtcgggt

SEQ ID NO: 651 - DNA, 24 bp, Artificial Sequence
  Description of Artificial Sequence: Synthetic oligonucleotide
gaccgactcgccggcgagtcggtc

SEQ ID NO: 652 - DNA, 24 bp, Artificial Sequence
  Description of Artificial Sequence: Synthetic oligonucleotide
gcacgactcgccggcgagtcgtgc

SEQ ID NO: 653 - DNA, 24 bp, Artificial Sequence
  Description of Artificial Sequence: Synthetic oligonucleotide
gccagactcgccggcgagtctggc

SEQ ID NO: 654 - DNA, 24 bp, Artificial Sequence
  Description of Artificial Sequence: Synthetic oligonucleotide
tcccgactcgccggcgagtcggga

SEQ ID NO: 655 - DNA, 24 bp, Artificial Sequence
  Description of Artificial Sequence: Synthetic oligonucleotide
gtccgactcgccggcgagtcggac

SEQ ID NO: 656 - DNA, 24 bp, Artificial Sequence
  Description of Artificial Sequence: Synthetic oligonucleotide
gcctgactcgccggcgagtcaggc

SEQ ID NO: 657 - DNA, 24 bp, Artificial Sequence
  Description of Artificial Sequence: Synthetic oligonucleotide
gggcgactcgccggcgagtcgccc

SEQ ID NO: 658 - DNA, 24 bp, Artificial Sequence
  Description of Artificial Sequence: Synthetic oligonucleotide
aggcgactcgccggcgagtcgcct

SEQ ID NO: 659 - DNA, 24 bp, Artificial Sequence
  Description of Artificial Sequence: Synthetic oligonucleotide
gagcgactcgccggcgagtcgctc

SEQ ID NO: 660 - DNA, 24 bp, Artificial Sequence
  Description of Artificial Sequence: Synthetic oligonucleotide
ggacgactcgccggcgagtcgtcc

SEQ ID NO: 661 - DNA, 24 bp, Artificial Sequence
  Description of Artificial Sequence: Synthetic oligonucleotide
gggagactcgccggcgagtctccc

SEQ ID NO: 662 - DNA, 24 bp, Artificial Sequence
  Description of Artificial Sequence: Synthetic oligonucleotide
tggcgactcgccggcgagtcgcca

SEQ ID NO: 663 - DNA, 24 bp, Artificial Sequence
  Description of Artificial Sequence: Synthetic oligonucleotide
gtgcgactcgccggcgagtcgcac

SEQ ID NO: 664 - DNA, 24 bp, Artificial Sequence
  Description of Artificial Sequence: Synthetic oligonucleotide
gggtgactcgccggcgagtcaccc

SEQ ID NO: 665 - DNA, 24 bp, Artificial Sequence
  Description of Artificial Sequence: Synthetic oligonucleotide
acgggactcgccggcgagtcccgt

SEQ ID NO: 666 - DNA, 24 bp, Artificial Sequence
  Description of Artificial Sequence: Synthetic oligonucleotide
cagggactcgccggcgagtccctg

SEQ ID NO: 667 - DNA, 24 bp, Artificial Sequence
  Description of Artificial Sequence: Synthetic oligonucleotide
ccaggactcgccggcgagtcctgg

SEQ ID NO: 668 - DNA, 24 bp, Artificial Sequence
  Description of Artificial Sequence: Synthetic oligonucleotide
ccgagactcgccggcgagtctcgg

SEQ ID NO: 669 - DNA, 24 bp, Artificial Sequence
  Description of Artificial Sequence: Synthetic oligonucleotide
tcgggactcgccggcgagtcccga

SEQ ID NO: 670 - DNA, 24 bp, Artificial Sequence
  Description of Artificial Sequence: Synthetic oligonucleotide
ctgggactcgccggcgagtcccag

SEQ ID NO: 671 - DNA, 24 bp, Artificial Sequence
  Description of Artificial Sequence: Synthetic oligonucleotide
cctggactcgccggcgagtccagg

SEQ ID NO: 672 - DNA, 24 bp, Artificial Sequence
  Description of Artificial Sequence: Synthetic oligonucleotide
ccgtgactcgccggcgagtcacgg

SEQ ID NO: 673 - DNA, 24 bp, Artificial Sequence
  Description of Artificial Sequence: Synthetic oligonucleotide
cggcgactcgccggcgagtcgccg

SEQ ID NO: 674 - DNA, 24 bp, Artificial Sequence
  Description of Artificial Sequence: Synthetic oligonucleotide
cagcgactcgccggcgagtcgctg

SEQ ID NO: 675 - DNA, 24 bp, Artificial Sequence
  Description of Artificial Sequence: Synthetic oligonucleotide
cgacgactcgccggcgagtcgtcg

SEQ ID NO: 676 - DNA, 24 bp, Artificial Sequence
  Description of Artificial Sequence: Synthetic oligonucleotide
cggagactcgccggcgagtctccg

SEQ ID NO: 677 - DNA, 24 bp, Artificial Sequence
  Description of Artificial Sequence: Synthetic oligonucleotide
ctgcgactcgccggcgagtcgcag

SEQ ID NO: 678 - DNA, 24 bp, Artificial Sequence
  Description of Artificial Sequence: Synthetic oligonucleotide
cggtgactcgccggcgagtcaccg

SEQ ID NO: 679 - DNA, 24 bp, Artificial Sequence
  Description of Artificial Sequence: Synthetic oligonucleotide
cacggactcgccggcgagtccgtg

SEQ ID NO: 680 - DNA, 24 bp, Artificial Sequence
  Description of Artificial Sequence: Synthetic oligonucleotide
cccagactcgccggcgagtctggg

SEQ ID NO: 681 - DNA, 24 bp, Artificial Sequence
  Description of Artificial Sequence: Synthetic oligonucleotide
ctcggactcgccggcgagtccgag

SEQ ID NO: 682 - DNA, 24 bp, Artificial Sequence
  Description of Artificial Sequence: Synthetic oligonucleotide
ccctgactcgccggcgagtcaggg

SEQ ID NO: 683 - DNA, 24 bp, Artificial Sequence
  Description of Artificial Sequence: Synthetic oligonucleotide
ccacgactcgccggcgagtcgtgg

SEQ ID NO: 684 - DNA, 24 bp, Artificial Sequence
  Description of Artificial Sequence: Synthetic oligonucleotide
agccgactcgccggcgagtcggct

SEQ ID NO: 685 - DNA, 24 bp, Artificial Sequence
  Description of Artificial Sequence: Synthetic oligonucleotide
tgccgactcgccggcgagtcggca

SEQ ID NO: 686 - DNA, 24 bp, Artificial Sequence
  Description of Artificial Sequence: Synthetic oligonucleotide
gcgagactcgccggcgagtctcgc

SEQ ID NO: 687 - DNA, 24 bp, Artificial Sequence
  Description of Artificial Sequence: Synthetic oligonucleotide
gcgtgactcgccggcgagtcacgc

SEQ ID NO: 688 - DNA, 24 bp, Artificial Sequence
  Description of Artificial Sequence: Synthetic oligonucleotide
gcaggactcgccggcgagtcctgc

SEQ ID NO: 689 - DNA, 24 bp, Artificial Sequence
  Description of Artificial Sequence: Synthetic oligonucleotide
gctggactcgccggcgagtccagc

SEQ ID NO: 690 - DNA, 24 bp, Artificial Sequence
  Description of Artificial Sequence: Synthetic oligonucleotide
cgaggactcgccggcgagtcctcg

SEQ ID NO: 691 - DNA, 24 bp, Artificial Sequence
  Description of Artificial Sequence: Synthetic oligonucleotide
cgtggactcgccggcgagtccacg

SEQ ID NO: 692 - DNA, 24 bp, Artificial Sequence
  Description of Artificial Sequence: Synthetic oligonucleotide
caccgactcgccggcgagtcggtg

SEQ ID NO: 693 - DNA, 24 bp, Artificial Sequence
  Description of Artificial Sequence: Synthetic oligonucleotide
ctccgactcgccggcgagtcggag

SEQ ID NO: 694 - DNA, 24 bp, Artificial Sequence
  Description of Artificial Sequence: Synthetic oligonucleotide
gcgggactcgccggcgagtcccgc

SEQ ID NO: 695 - DNA, 24 bp, Artificial Sequence
  Description of Artificial Sequence: Synthetic oligonucleotide
gagggactcgccggcgagtccctc

SEQ ID NO: 696 - DNA, 24 bp, Artificial Sequence
  Description of Artificial Sequence: Synthetic oligonucleotide
gtgggactcgccggcgagtcccac

SEQ ID NO: 697 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcacatgtgagtcnnnn

SEQ ID NO: 698 - DNA, 24 bp, Artificial Sequence
  Description of Artificial Sequence: Synthetic oligonucleotide
ggcggactcacatgtgagtccgcc

SEQ ID NO: 699 - DNA, 24 bp, Artificial Sequence
  Description of Artificial Sequence: Synthetic oligonucleotide
agcggactcacatgtgagtccgct

SEQ ID NO: 700 - DNA, 24 bp, Artificial Sequence
  Description of Artificial Sequence: Synthetic oligonucleotide
gacggactcacatgtgagtccgtc

SEQ ID NO: 701 - DNA, 24 bp, Artificial Sequence
  Description of Artificial Sequence: Synthetic oligonucleotide
ggaggactcacatgtgagtcctcc

SEQ ID NO: 702 - DNA, 24 bp, Artificial Sequence
  Description of Artificial Sequence: Synthetic oligonucleotide
ggcagactcacatgtgagtctgcc

SEQ ID NO: 703 - DNA, 24 bp, Artificial Sequence
  Description of Artificial Sequence: Synthetic oligonucleotide
tgcggactcacatgtgagtccgca

SEQ ID NO: 704 - DNA, 24 bp, Artificial Sequence
  Description of Artificial Sequence: Synthetic oligonucleotide
gtcggactcacatgtgagtccgac

SEQ ID NO: 705 - DNA, 24 bp, Artificial Sequence
  Description of Artificial Sequence: Synthetic oligonucleotide
ggtggactcacatgtgagtccacc

SEQ ID NO: 706 - DNA, 24 bp, Artificial Sequence
  Description of Artificial Sequence: Synthetic oligonucleotide
ggctgactcacatgtgagtcagcc

SEQ ID NO: 707 - DNA, 24 bp, Artificial Sequence
  Description of Artificial Sequence: Synthetic oligonucleotide
gcccgactcacatgtgagtcgggc

SEQ ID NO: 708 - DNA, 24 bp, Artificial Sequence
  Description of Artificial Sequence: Synthetic oligonucleotide
acccgactcacatgtgagtcgggt

SEQ ID NO: 709 - DNA, 24 bp, Artificial Sequence
  Description of Artificial Sequence: Synthetic oligonucleotide
gaccgactcacatgtgagtcggtc

SEQ ID NO: 710 - DNA, 24 bp, Artificial Sequence
  Description of Artificial Sequence: Synthetic oligonucleotide
gcacgactcacatgtgagtcgtgc

SEQ ID NO: 711 - DNA, 24 bp, Artificial Sequence
  Description of Artificial Sequence: Synthetic oligonucleotide
gccagactcacatgtgagtctggc

SEQ ID NO: 712 - DNA, 24 bp, Artificial Sequence
  Description of Artificial Sequence: Synthetic oligonucleotide
tcccgactcacatgtgagtcggga

SEQ ID NO: 713 - DNA, 24 bp, Artificial Sequence
  Description of Artificial Sequence: Synthetic oligonucleotide
gtccgactcacatgtgagtcggac

SEQ ID NO: 714 - DNA, 24 bp, Artificial Sequence
  Description of Artificial Sequence: Synthetic oligonucleotide
gcctgactcacatgtgagtcaggc

SEQ ID NO: 715 - DNA, 24 bp, Artificial Sequence
  Description of Artificial Sequence: Synthetic oligonucleotide
gggcgactcacatgtgagtcgccc

SEQ ID NO: 716 - DNA, 24 bp, Artificial Sequence
  Description of Artificial Sequence: Synthetic oligonucleotide
aggcgactcacatgtgagtcgcct

SEQ ID NO: 717 - DNA, 24 bp, Artificial Sequence
  Description of Artificial Sequence: Synthetic oligonucleotide
gagcgactcacatgtgagtcgctc

SEQ ID NO: 718 - DNA, 24 bp, Artificial Sequence
  Description of Artificial Sequence: Synthetic oligonucleotide
ggacgactcacatgtgagtcgtcc

SEQ ID NO: 719 - DNA, 24 bp, Artificial Sequence
  Description of Artificial Sequence: Synthetic oligonucleotide
gggagactcacatgtgagtctccc

SEQ ID NO: 720 - DNA, 24 bp, Artificial Sequence
  Description of Artificial Sequence: Synthetic oligonucleotide
tggcgactcacatgtgagtcgcca

SEQ ID NO: 721 - DNA, 24 bp, Artificial Sequence
  Description of Artificial Sequence: Synthetic oligonucleotide
gtgcgactcacatgtgagtcgcac

SEQ ID NO: 722 - DNA, 24 bp, Artificial Sequence
  Description of Artificial Sequence: Synthetic oligonucleotide
gggtgactcacatgtgagtcaccc

SEQ ID NO: 723 - DNA, 24 bp, Artificial Sequence
  Description of Artificial Sequence: Synthetic oligonucleotide
acgggactcacatgtgagtcccgt

SEQ ID NO: 724 - DNA, 24 bp, Artificial Sequence
  Description of Artificial Sequence: Synthetic oligonucleotide
cagggactcacatgtgagtccctg

SEQ ID NO: 725 - DNA, 24 bp, Artificial Sequence
  Description of Artificial Sequence: Synthetic oligonucleotide
ccaggactcacatgtgagtcctgg

SEQ ID NO: 726 - DNA, 24 bp, Artificial Sequence
  Description of Artificial Sequence: Synthetic oligonucleotide
ccgagactcacatgtgagtctcgg

SEQ ID NO: 727 - DNA, 24 bp, Artificial Sequence
  Description of Artificial Sequence: Synthetic oligonucleotide
tcgggactcacatgtgagtcccga

SEQ ID NO: 728 - DNA, 24 bp, Artificial Sequence
  Description of Artificial Sequence: Synthetic oligonucleotide
ctgggactcacatgtgagtcccag

SEQ ID NO: 729 - DNA, 24 bp, Artificial Sequence
  Description of Artificial Sequence: Synthetic oligonucleotide
cctggactcacatgtgagtccagg

SEQ ID NO: 730 - DNA, 24 bp, Artificial Sequence
  Description of Artificial Sequence: Synthetic oligonucleotide
ccgtgactcacatgtgagtcacgg

SEQ ID NO: 731 - DNA, 24 bp, Artificial Sequence
  Description of Artificial Sequence: Synthetic oligonucleotide
cggcgactcacatgtgagtcgccg

SEQ ID NO: 732 - DNA, 24 bp, Artificial Sequence
  Description of Artificial Sequence: Synthetic oligonucleotide
cagcgactcacatgtgagtcgctg

SEQ ID NO: 733 - DNA, 24 bp, Artificial Sequence
  Description of Artificial Sequence: Synthetic oligonucleotide
cgacgactcacatgtgagtcgtcg

SEQ ID NO: 734 - DNA, 24 bp, Artificial Sequence
  Description of Artificial Sequence: Synthetic oligonucleotide
cggagactcacatgtgagtctccg

SEQ ID NO: 735 - DNA, 24 bp, Artificial Sequence
  Description of Artificial Sequence: Synthetic oligonucleotide
ctgcgactcacatgtgagtcgcag

SEQ ID NO: 736 - DNA, 24 bp, Artificial Sequence
  Description of Artificial Sequence: Synthetic oligonucleotide
cggtgactcacatgtgagtcaccg

SEQ ID NO: 737 - DNA, 24 bp, Artificial Sequence
  Description of Artificial Sequence: Synthetic oligonucleotide
cacggactcacatgtgagtccgtg

SEQ ID NO: 738 - DNA, 24 bp, Artificial Sequence
  Description of Artificial Sequence: Synthetic oligonucleotide
cccagactcacatgtgagtctggg

SEQ ID NO: 739 - DNA, 24 bp, Artificial Sequence
  Description of Artificial Sequence: Synthetic oligonucleotide
ctcggactcacatgtgagtccgag

SEQ ID NO: 740 - DNA, 24 bp, Artificial Sequence
  Description of Artificial Sequence: Synthetic oligonucleotide
ccctgactcacatgtgagtcaggg

SEQ ID NO: 741 - DNA, 24 bp, Artificial Sequence
  Description of Artificial Sequence: Synthetic oligonucleotide
ccacgactcacatgtgagtcgtgg

SEQ ID NO: 742 - DNA, 24 bp, Artificial Sequence
  Description of Artificial Sequence: Synthetic oligonucleotide
agccgactcacatgtgagtcggct

SEQ ID NO: 743 - DNA, 24 bp, Artificial Sequence
  Description of Artificial Sequence: Synthetic oligonucleotide
tgccgactcacatgtgagtcggca

SEQ ID NO: 744 - DNA, 24 bp, Artificial Sequence
  Description of Artificial Sequence: Synthetic oligonucleotide
gcgagactcacatgtgagtctcgc

SEQ ID NO: 745 - DNA, 24 bp, Artificial Sequence
  Description of Artificial Sequence: Synthetic oligonucleotide
gcgtgactcacatgtgagtcacgc

SEQ ID NO: 746 - DNA, 24 bp, Artificial Sequence
  Description of Artificial Sequence: Synthetic oligonucleotide
gcaggactcacatgtgagtcctgc

SEQ ID NO: 747 - DNA, 24 bp, Artificial Sequence
  Description of Artificial Sequence: Synthetic oligonucleotide
gctggactcacatgtgagtccagc

SEQ ID NO: 748 - DNA, 24 bp, Artificial Sequence
  Description of Artificial Sequence: Synthetic oligonucleotide
cgaggactcacatgtgagtcctcg

SEQ ID NO: 749 - DNA, 24 bp, Artificial Sequence
  Description of Artificial Sequence: Synthetic oligonucleotide
cgtggactcacatgtgagtccacg

SEQ ID NO: 750 - DNA, 24 bp, Artificial Sequence
  Description of Artificial Sequence: Synthetic oligonucleotide
caccgactcacatgtgagtcggtg

SEQ ID NO: 751 - DNA, 24 bp, Artificial Sequence
  Description of Artificial Sequence: Synthetic oligonucleotide
ctccgactcacatgtgagtcggag

SEQ ID NO: 752 - DNA, 24 bp, Artificial Sequence
  Description of Artificial Sequence: Synthetic oligonucleotide
gcgggactcacatgtgagtcccgc

SEQ ID NO: 753 - DNA, 24 bp, Artificial Sequence
  Description of Artificial Sequence: Synthetic oligonucleotide
gagggactcacatgtgagtccctc

SEQ ID NO: 754 - DNA, 24 bp, Artificial Sequence
  Description of Artificial Sequence: Synthetic oligonucleotide
gtgggactcacatgtgagtcccac

SEQ ID NO: 755 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcactagtgagtcnnnn

SEQ ID NO: 756 - DNA, 24 bp, Artificial Sequence
  Description of Artificial Sequence: Synthetic oligonucleotide
ggcggactcactagtgagtccgcc

SEQ ID NO: 757 - DNA, 24 bp, Artificial Sequence
  Description of Artificial Sequence: Synthetic oligonucleotide
agcggactcactagtgagtccgct

SEQ ID NO: 758 - DNA, 24 bp, Artificial Sequence
  Description of Artificial Sequence: Synthetic oligonucleotide
gacggactcactagtgagtccgtc

SEQ ID NO: 759 - DNA, 24 bp, Artificial Sequence
  Description of Artificial Sequence: Synthetic oligonucleotide
ggaggactcactagtgagtcctcc

SEQ ID NO: 760 - DNA, 24 bp, Artificial Sequence
  Description of Artificial Sequence: Synthetic oligonucleotide
ggcagactcactagtgagtctgcc

SEQ ID NO: 761 - DNA, 24 bp, Artificial Sequence
  Description of Artificial Sequence: Synthetic oligonucleotide
tgcggactcactagtgagtccgca

SEQ ID NO: 762 - DNA, 24 bp, Artificial Sequence
  Description of Artificial Sequence: Synthetic oligonucleotide
gtcggactcactagtgagtccgac

SEQ ID NO: 763 - DNA, 24 bp, Artificial Sequence
  Description of Artificial Sequence: Synthetic oligonucleotide
ggtggactcactagtgagtccacc

SEQ ID NO: 764 - DNA, 24 bp, Artificial Sequence
  Description of Artificial Sequence: Synthetic oligonucleotide
ggctgactcactagtgagtcagcc

SEQ ID NO: 765 - DNA, 24 bp, Artificial Sequence
  Description of Artificial Sequence: Synthetic oligonucleotide
gcccgactcactagtgagtcgggc

SEQ ID NO: 766 - DNA, 24 bp, Artificial Sequence
  Description of Artificial Sequence: Synthetic oligonucleotide
acccgactcactagtgagtcgggt

SEQ ID NO: 767 - DNA, 24 bp, Artificial Sequence
  Description of Artificial Sequence: Synthetic oligonucleotide
gaccgactcactagtgagtcggtc

SEQ ID NO: 768 - DNA, 24 bp, Artificial Sequence
  Description of Artificial Sequence: Synthetic oligonucleotide
gcacgactcactagtgagtcgtgc

SEQ ID NO: 769 - DNA, 24 bp, Artificial Sequence
  Description of Artificial Sequence: Synthetic oligonucleotide
gccagactcactagtgagtctggc

SEQ ID NO: 770 - DNA, 24 bp, Artificial Sequence
  Description of Artificial Sequence: Synthetic oligonucleotide
tcccgactcactagtgagtcggga

SEQ ID NO: 771 - DNA, 24 bp, Artificial Sequence
  Description of Artificial Sequence: Synthetic oligonucleotide
gtccgactcactagtgagtcggac

SEQ ID NO: 772 - DNA, 24 bp, Artificial Sequence
  Description of Artificial Sequence: Synthetic oligonucleotide
gcctgactcactagtgagtcaggc

SEQ ID NO: 773 - DNA, 24 bp, Artificial Sequence
  Description of Artificial Sequence: Synthetic oligonucleotide
gggcgactcactagtgagtcgccc

SEQ ID NO: 774 - DNA, 24 bp, Artificial Sequence
  Description of Artificial Sequence: Synthetic oligonucleotide
aggcgactcactagtgagtcgcct

SEQ ID NO: 775 - DNA, 24 bp, Artificial Sequence
  Description of Artificial Sequence: Synthetic oligonucleotide
gagcgactcactagtgagtcgctc

SEQ ID NO: 776 - DNA, 24 bp, Artificial Sequence
  Description of Artificial Sequence: Synthetic oligonucleotide
ggacgactcactagtgagtcgtcc

SEQ ID NO: 777 - DNA, 24 bp, Artificial Sequence
  Description of Artificial Sequence: Synthetic oligonucleotide
gggagactcactagtgagtctccc

SEQ ID NO: 778 - DNA, 24 bp, Artificial Sequence
  Description of Artificial Sequence: Synthetic oligonucleotide
tggcgactcactagtgagtcgcca

SEQ ID NO: 779 - DNA, 24 bp, Artificial Sequence
  Description of Artificial Sequence: Synthetic oligonucleotide
gtgcgactcactagtgagtcgcac

SEQ ID NO: 780 - DNA, 24 bp, Artificial Sequence
  Description of Artificial Sequence: Synthetic oligonucleotide
gggtgactcactagtgagtcaccc

SEQ ID NO: 781 - DNA, 24 bp, Artificial Sequence
  Description of Artificial Sequence: Synthetic oligonucleotide
acgggactcactagtgagtcccgt

SEQ ID NO: 782 - DNA, 24 bp, Artificial Sequence
  Description of Artificial Sequence: Synthetic oligonucleotide
cagggactcactagtgagtccctg

SEQ ID NO: 783 - DNA, 24 bp, Artificial Sequence
  Description of Artificial Sequence: Synthetic oligonucleotide
ccaggactcactagtgagtcctgg

SEQ ID NO: 784 - DNA, 24 bp, Artificial Sequence
  Description of Artificial Sequence: Synthetic oligonucleotide
ccgagactcactagtgagtctcgg

SEQ ID NO: 785 - DNA, 24 bp, Artificial Sequence
  Description of Artificial Sequence: Synthetic oligonucleotide
tcgggactcactagtgagtcccga

SEQ ID NO: 786 - DNA, 24 bp, Artificial Sequence
  Description of Artificial Sequence: Synthetic oligonucleotide
ctgggactcactagtgagtcccag

SEQ ID NO: 787 - DNA, 24 bp, Artificial Sequence
  Description of Artificial Sequence: Synthetic oligonucleotide
cctggactcactagtgagtccagg

SEQ ID NO: 788 - DNA, 24 bp, Artificial Sequence
  Description of Artificial Sequence: Synthetic oligonucleotide
ccgtgactcactagtgagtcacgg

SEQ ID NO: 789 - DNA, 24 bp, Artificial Sequence
  Description of Artificial Sequence: Synthetic oligonucleotide
cggcgactcactagtgagtcgccg

SEQ ID NO: 790 - DNA, 24 bp, Artificial Sequence
  Description of Artificial Sequence: Synthetic oligonucleotide
cagcgactcactagtgagtcgctg

SEQ ID NO: 791 - DNA, 24 bp, Artificial Sequence
  Description of Artificial Sequence: Synthetic oligonucleotide
cgacgactcactagtgagtcgtcg

SEQ ID NO: 792 - DNA, 24 bp, Artificial Sequence
  Description of Artificial Sequence: Synthetic oligonucleotide
cggagactcactagtgagtctccg

SEQ ID NO: 793 - DNA, 24 bp, Artificial Sequence
  Description of Artificial Sequence: Synthetic oligonucleotide
ctgcgactcactagtgagtcgcag

SEQ ID NO: 794 - DNA, 24 bp, Artificial Sequence
  Description of Artificial Sequence: Synthetic oligonucleotide
cggtgactcactagtgagtcaccg

SEQ ID NO: 795 - DNA, 24 bp, Artificial Sequence
  Description of Artificial Sequence: Synthetic oligonucleotide
cacggactcactagtgagtccgtg

SEQ ID NO: 796 - DNA, 24 bp, Artificial Sequence
  Description of Artificial Sequence: Synthetic oligonucleotide
cccagactcactagtgagtctggg

SEQ ID NO: 797 - DNA, 24 bp, Artificial Sequence
  Description of Artificial Sequence: Synthetic oligonucleotide
ctcggactcactagtgagtccgag

SEQ ID NO: 798 - DNA, 24 bp, Artificial Sequence
  Description of Artificial Sequence: Synthetic oligonucleotide
ccctgactcactagtgagtcaggg

SEQ ID NO: 799 - DNA, 24 bp, Artificial Sequence
  Description of Artificial Sequence: Synthetic oligonucleotide
ccacgactcactagtgagtcgtgg

SEQ ID NO: 800 - DNA, 24 bp, Artificial Sequence
  Description of Artificial Sequence: Synthetic oligonucleotide
agccgactcactagtgagtcggct

SEQ ID NO: 801 - DNA, 24 bp, Artificial Sequence
  Description of Artificial Sequence: Synthetic oligonucleotide
tgccgactcactagtgagtcggca

SEQ ID NO: 802 - DNA, 24 bp, Artificial Sequence
  Description of Artificial Sequence: Synthetic oligonucleotide
gcgagactcactagtgagtctcgc

SEQ ID NO: 803 - DNA, 24 bp, Artificial Sequence
  Description of Artificial Sequence: Synthetic oligonucleotide
gcgtgactcactagtgagtcacgc

SEQ ID NO: 804 - DNA, 24 bp, Artificial Sequence
  Description of Artificial Sequence: Synthetic oligonucleotide
gcaggactcactagtgagtcctgc

SEQ ID NO: 805 - DNA, 24 bp, Artificial Sequence
  Description of Artificial Sequence: Synthetic oligonucleotide
gctggactcactagtgagtccagc

SEQ ID NO: 806 - DNA, 24 bp, Artificial Sequence
  Description of Artificial Sequence: Synthetic oligonucleotide
cgaggactcactagtgagtcctcg

SEQ ID NO: 807 - DNA, 24 bp, Artificial Sequence
  Description of Artificial Sequence: Synthetic oligonucleotide
cgtggactcactagtgagtccacg

SEQ ID NO: 808 - DNA, 24 bp, Artificial Sequence
  Description of Artificial Sequence: Synthetic oligonucleotide
caccgactcactagtgagtcggtg

SEQ ID NO: 809 - DNA, 24 bp, Artificial Sequence
  Description of Artificial Sequence: Synthetic oligonucleotide
ctccgactcactagtgagtcggag

SEQ ID NO: 810 - DNA, 24 bp, Artificial Sequence
  Description of Artificial Sequence: Synthetic oligonucleotide
gcgggactcactagtgagtcccgc

SEQ ID NO: 811 - DNA, 24 bp, Artificial Sequence
  Description of Artificial Sequence: Synthetic oligonucleotide
gagggactcactagtgagtccctc

SEQ ID NO: 812 - DNA, 24 bp, Artificial Sequence
  Description of Artificial Sequence: Synthetic oligonucleotide
gtgggactcactagtgagtcccac

SEQ ID NO: 813 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcacgcgtgagtcnnnn

SEQ ID NO: 814 - DNA, 24 bp, Artificial Sequence
  Description of Artificial Sequence: Synthetic oligonucleotide
ggcggactcacgcgtgagtccgcc

SEQ ID NO: 815 - DNA, 24 bp, Artificial Sequence
  Description of Artificial Sequence: Synthetic oligonucleotide
agcggactcacgcgtgagtccgct

SEQ ID NO: 816 - DNA, 24 bp, Artificial Sequence
  Description of Artificial Sequence: Synthetic oligonucleotide
gacggactcacgcgtgagtccgtc

SEQ ID NO: 817 - DNA, 24 bp, Artificial Sequence
  Description of Artificial Sequence: Synthetic oligonucleotide
ggaggactcacgcgtgagtcctcc

SEQ ID NO: 818 - DNA, 24 bp, Artificial Sequence
  Description of Artificial Sequence: Synthetic oligonucleotide
ggcagactcacgcgtgagtctgcc

SEQ ID NO: 819 - DNA, 24 bp, Artificial Sequence
  Description of Artificial Sequence: Synthetic oligonucleotide
tgcggactcacgcgtgagtccgca

SEQ ID NO: 820 - DNA, 24 bp, Artificial Sequence
  Description of Artificial Sequence: Synthetic oligonucleotide
gtcggactcacgcgtgagtccgac

SEQ ID NO: 821 - DNA, 24 bp, Artificial Sequence
  Description of Artificial Sequence: Synthetic oligonucleotide
ggtggactcacgcgtgagtccacc

SEQ ID NO: 822 - DNA, 24 bp, Artificial Sequence
  Description of Artificial Sequence: Synthetic oligonucleotide
ggctgactcacgcgtgagtcagcc

SEQ ID NO: 823 - DNA, 24 bp, Artificial Sequence
  Description of Artificial Sequence: Synthetic oligonucleotide
gcccgactcacgcgtgagtcgggc

SEQ ID NO: 824 - DNA, 24 bp, Artificial Sequence
  Description of Artificial Sequence: Synthetic oligonucleotide
acccgactcacgcgtgagtcgggt

SEQ ID NO: 825 - DNA, 24 bp, Artificial Sequence
  Description of Artificial Sequence: Synthetic oligonucleotide
gaccgactcacgcgtgagtcggtc

SEQ ID NO: 826 - DNA, 24 bp, Artificial Sequence
  Description of Artificial Sequence: Synthetic oligonucleotide
gcacgactcacgcgtgagtcgtgc

SEQ ID NO: 827 - DNA, 24 bp, Artificial Sequence
  Description of Artificial Sequence: Synthetic oligonucleotide
gccagactcacgcgtgagtctggc

SEQ ID NO: 828 - DNA, 24 bp, Artificial Sequence
  Description of Artificial Sequence: Synthetic oligonucleotide
tcccgactcacgcgtgagtcggga

SEQ ID NO: 829 - DNA, 24 bp, Artificial Sequence
  Description of Artificial Sequence: Synthetic oligonucleotide
gtccgactcacgcgtgagtcggac

SEQ ID NO: 830 - DNA, 24 bp, Artificial Sequence
  Description of Artificial Sequence: Synthetic oligonucleotide
gcctgactcacgcgtgagtcaggc

SEQ ID NO: 831 - DNA, 24 bp, Artificial Sequence
  Description of Artificial Sequence: Synthetic oligonucleotide
gggcgactcacgcgtgagtcgccc

SEQ ID NO: 832 - DNA, 24 bp, Artificial Sequence
  Description of Artificial Sequence: Synthetic oligonucleotide
aggcgactcacgcgtgagtcgcct

SEQ ID NO: 833 - DNA, 24 bp, Artificial Sequence
  Description of Artificial Sequence: Synthetic oligonucleotide
gagcgactcacgcgtgagtcgctc

SEQ ID NO: 834 - DNA, 24 bp, Artificial Sequence
  Description of Artificial Sequence: Synthetic oligonucleotide
ggacgactcacgcgtgagtcgtcc

SEQ ID NO: 835 - DNA, 24 bp, Artificial Sequence
  Description of Artificial Sequence: Synthetic oligonucleotide
gggagactcacgcgtgagtctccc

SEQ ID NO: 836 - DNA, 24 bp, Artificial Sequence
  Description of Artificial Sequence: Synthetic oligonucleotide
tggcgactcacgcgtgagtcgcca

SEQ ID NO: 837 - DNA, 24 bp, Artificial Sequence
  Description of Artificial Sequence: Synthetic oligonucleotide
gtgcgactcacgcgtgagtcgcac

SEQ ID NO: 838 - DNA, 24 bp, Artificial Sequence
  Description of Artificial Sequence: Synthetic oligonucleotide
gggtgactcacgcgtgagtcaccc

SEQ ID NO: 839 - DNA, 24 bp, Artificial Sequence
  Description of Artificial Sequence: Synthetic oligonucleotide
acgggactcacgcgtgagtcccgt

SEQ ID NO: 840 - DNA, 24 bp, Artificial Sequence
  Description of Artificial Sequence: Synthetic oligonucleotide
cagggactcacgcgtgagtccctg

SEQ ID NO: 841 - DNA, 24 bp, Artificial Sequence
  Description of Artificial Sequence: Synthetic oligonucleotide
ccaggactcacgcgtgagtcctgg

SEQ ID NO: 842 - DNA, 24 bp, Artificial Sequence
  Description of Artificial Sequence: Synthetic oligonucleotide
ccgagactcacgcgtgagtctcgg

SEQ ID NO: 843 - DNA, 24 bp, Artificial Sequence
  Description of Artificial Sequence: Synthetic oligonucleotide
tcgggactcacgcgtgagtcccga

SEQ ID NO: 844 - DNA, 24 bp, Artificial Sequence
  Description of Artificial Sequence: Synthetic oligonucleotide
ctgggactcacgcgtgagtcccag

SEQ ID NO: 845 - DNA, 24 bp, Artificial Sequence
  Description of Artificial Sequence: Synthetic oligonucleotide
cctggactcacgcgtgagtccagg

SEQ ID NO: 846 - DNA, 24 bp, Artificial Sequence
  Description of Artificial Sequence: Synthetic oligonucleotide
ccgtgactcacgcgtgagtcacgg

SEQ ID NO: 847 - DNA, 24 bp, Artificial Sequence
  Description of Artificial Sequence: Synthetic oligonucleotide
cggcgactcacgcgtgagtcgccg

SEQ ID NO: 848 - DNA, 24 bp, Artificial Sequence
  Description of Artificial Sequence: Synthetic oligonucleotide
cagcgactcacgcgtgagtcgctg

SEQ ID NO: 849 - DNA, 24 bp, Artificial Sequence
  Description of Artificial Sequence: Synthetic oligonucleotide
cgacgactcacgcgtgagtcgtcg

SEQ ID NO: 850 - DNA, 24 bp, Artificial Sequence
  Description of Artificial Sequence: Synthetic oligonucleotide
cggagactcacgcgtgagtctccg

SEQ ID NO: 851 - DNA, 24 bp, Artificial Sequence
  Description of Artificial Sequence: Synthetic oligonucleotide
ctgcgactcacgcgtgagtcgcag

SEQ ID NO: 852 - DNA, 24 bp, Artificial Sequence
  Description of Artificial Sequence: Synthetic oligonucleotide
cggtgactcacgcgtgagtcaccg

SEQ ID NO: 853 - DNA, 24 bp, Artificial Sequence
  Description of Artificial Sequence: Synthetic oligonucleotide
cacggactcacgcgtgagtccgtg

SEQ ID NO: 854 - DNA, 24 bp, Artificial Sequence
  Description of Artificial Sequence: Synthetic oligonucleotide
cccagactcacgcgtgagtctggg

SEQ ID NO: 855 - DNA, 24 bp, Artificial Sequence
  Description of Artificial Sequence: Synthetic oligonucleotide
ctcggactcacgcgtgagtccgag

SEQ ID NO: 856 - DNA, 24 bp, Artificial Sequence
  Description of Artificial Sequence: Synthetic oligonucleotide
ccctgactcacgcgtgagtcaggg

SEQ ID NO: 857 - DNA, 24 bp, Artificial Sequence
  Description of Artificial Sequence: Synthetic oligonucleotide
ccacgactcacgcgtgagtcgtgg

SEQ ID NO: 858 - DNA, 24 bp, Artificial Sequence
  Description of Artificial Sequence: Synthetic oligonucleotide
agccgactcacgcgtgagtcggct

SEQ ID NO: 859 - DNA, 24 bp, Artificial Sequence
  Description of Artificial Sequence: Synthetic oligonucleotide
tgccgactcacgcgtgagtcggca

SEQ ID NO: 860 - DNA, 24 bp, Artificial Sequence
  Description of Artificial Sequence: Synthetic oligonucleotide
gcgagactcacgcgtgagtctcgc

SEQ ID NO: 861 - DNA, 24 bp, Artificial Sequence
  Description of Artificial Sequence: Synthetic oligonucleotide
gcgtgactcacgcgtgagtcacgc

SEQ ID NO: 862 - DNA, 24 bp, Artificial Sequence
  Description of Artificial Sequence: Synthetic oligonucleotide
gcaggactcacgcgtgagtcctgc

SEQ ID NO: 863 - DNA, 24 bp, Artificial Sequence
  Description of Artificial Sequence: Synthetic oligonucleotide
gctggactcacgcgtgagtccagc

SEQ ID NO: 864 - DNA, 24 bp, Artificial Sequence
  Description of Artificial Sequence: Synthetic oligonucleotide
cgaggactcacgcgtgagtcctcg

SEQ ID NO: 865 - DNA, 24 bp, Artificial Sequence
  Description of Artificial Sequence: Synthetic oligonucleotide
cgtggactcacgcgtgagtccacg

SEQ ID NO: 866 - DNA, 24 bp, Artificial Sequence
  Description of Artificial Sequence: Synthetic oligonucleotide
caccgactcacgcgtgagtcggtg

SEQ ID NO: 867 - DNA, 24 bp, Artificial Sequence
  Description of Artificial Sequence: Synthetic oligonucleotide
ctccgactcacgcgtgagtcggag

SEQ ID NO: 868 - DNA, 24 bp, Artificial Sequence
  Description of Artificial Sequence: Synthetic oligonucleotide
gcgggactcacgcgtgagtcccgc

SEQ ID NO: 869 - DNA, 24 bp, Artificial Sequence
  Description of Artificial Sequence: Synthetic oligonucleotide
gagggactcacgcgtgagtccctc

SEQ ID NO: 870 - DNA, 24 bp, Artificial Sequence
  Description of Artificial Sequence: Synthetic oligonucleotide
gtgggactcacgcgtgagtcccac

SEQ ID NO: 871 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaccggtgagtcnnnn

SEQ ID NO: 872 - DNA, 24 bp, Artificial Sequence
  Description of Artificial Sequence: Synthetic oligonucleotide
ggcggactcaccggtgagtccgcc

SEQ ID NO: 873 - DNA, 24 bp, Artificial Sequence
  Description of Artificial Sequence: Synthetic oligonucleotide
agcggactcaccggtgagtccgct

SEQ ID NO: 874 - DNA, 24 bp, Artificial Sequence
  Description of Artificial Sequence: Synthetic oligonucleotide
gacggactcaccggtgagtccgtc

SEQ ID NO: 875 - DNA, 24 bp, Artificial Sequence
  Description of Artificial Sequence: Synthetic oligonucleotide
ggaggactcaccggtgagtcctcc

SEQ ID NO: 876 - DNA, 24 bp, Artificial Sequence
  Description of Artificial Sequence: Synthetic oligonucleotide
ggcagactcaccggtgagtctgcc

SEQ ID NO: 877 - DNA, 24 bp, Artificial Sequence
  Description of Artificial Sequence: Synthetic oligonucleotide
tgcggactcaccggtgagtccgca

SEQ ID NO: 878 - DNA, 24 bp, Artificial Sequence
  Description of Artificial Sequence: Synthetic oligonucleotide
gtcggactcaccggtgagtccgac

SEQ ID NO: 879 - DNA, 24 bp, Artificial Sequence
  Description of Artificial Sequence: Synthetic oligonucleotide
ggtggactcaccggtgagtccacc

SEQ ID NO: 880 - DNA, 24 bp, Artificial Sequence
  Description of Artificial Sequence: Synthetic oligonucleotide
ggctgactcaccggtgagtcagcc

SEQ ID NO: 881 - DNA, 24 bp, Artificial Sequence
  Description of Artificial Sequence: Synthetic oligonucleotide
gcccgactcaccggtgagtcgggc

SEQ ID NO: 882 - DNA, 24 bp, Artificial Sequence
  Description of Artificial Sequence: Synthetic oligonucleotide
acccgactcaccggtgagtcgggt

SEQ ID NO: 883 - DNA, 24 bp, Artificial Sequence
  Description of Artificial Sequence: Synthetic oligonucleotide
gaccgactcaccggtgagtcggtc

SEQ ID NO: 884 - DNA, 24 bp, Artificial Sequence
  Description of Artificial Sequence: Synthetic oligonucleotide
gcacgactcaccggtgagtcgtgc

SEQ ID NO: 885 - DNA, 24 bp, Artificial Sequence
  Description of Artificial Sequence: Synthetic oligonucleotide
gccagactcaccggtgagtctggc

SEQ ID NO: 886 - DNA, 24 bp, Artificial Sequence
  Description of Artificial Sequence: Synthetic oligonucleotide
tcccgactcaccggtgagtcggga

SEQ ID NO: 887 - DNA, 24 bp, Artificial Sequence
  Description of Artificial Sequence: Synthetic oligonucleotide
gtccgactcaccggtgagtcggac

SEQ ID NO: 888 - DNA, 24 bp, Artificial Sequence
  Description of Artificial Sequence: Synthetic oligonucleotide
gcctgactcaccggtgagtcaggc

SEQ ID NO: 889 - DNA, 24 bp, Artificial Sequence
  Description of Artificial Sequence: Synthetic oligonucleotide
gggcgactcaccggtgagtcgccc

SEQ ID NO: 890 - DNA, 24 bp, Artificial Sequence
  Description of Artificial Sequence: Synthetic oligonucleotide
aggcgactcaccggtgagtcgcct

SEQ ID NO: 891 - DNA, 24 bp, Artificial Sequence
  Description of Artificial Sequence: Synthetic oligonucleotide
gagcgactcaccggtgagtcgctc

SEQ ID NO: 892 - DNA, 24 bp, Artificial Sequence
  Description of Artificial Sequence: Synthetic oligonucleotide
ggacgactcaccggtgagtcgtcc

SEQ ID NO: 893 - DNA, 24 bp, Artificial Sequence
  Description of Artificial Sequence: Synthetic oligonucleotide
gggagactcaccggtgagtctccc

SEQ ID NO: 894 - DNA, 24 bp, Artificial Sequence
  Description of Artificial Sequence: Synthetic oligonucleotide
tggcgactcaccggtgagtcgcca

SEQ ID NO: 895 - DNA, 24 bp, Artificial Sequence
  Description of Artificial Sequence: Synthetic oligonucleotide
gtgcgactcaccggtgagtcgcac

SEQ ID NO: 896 - DNA, 24 bp, Artificial Sequence
  Description of Artificial Sequence: Synthetic oligonucleotide
gggtgactcaccggtgagtcaccc

SEQ ID NO: 897 - DNA, 24 bp, Artificial Sequence
  Description of Artificial Sequence: Synthetic oligonucleotide
acgggactcaccggtgagtcccgt

SEQ ID NO: 898 - DNA, 24 bp, Artificial Sequence
  Description of Artificial Sequence: Synthetic oligonucleotide
cagggactcaccggtgagtccctg

SEQ ID NO: 899 - DNA, 24 bp, Artificial Sequence
  Description of Artificial Sequence: Synthetic oligonucleotide
ccaggactcaccggtgagtcctgg

SEQ ID NO: 900 - DNA, 24 bp, Artificial Sequence
  Description of Artificial Sequence: Synthetic oligonucleotide
ccgagactcaccggtgagtctcgg

SEQ ID NO: 901 - DNA, 24 bp, Artificial Sequence
  Description of Artificial Sequence: Synthetic oligonucleotide
tcgggactcaccggtgagtcccga

SEQ ID NO: 902 - DNA, 24 bp, Artificial Sequence
  Description of Artificial Sequence: Synthetic oligonucleotide
ctgggactcaccggtgagtcccag

SEQ ID NO: 903 - DNA, 24 bp, Artificial Sequence
  Description of Artificial Sequence: Synthetic oligonucleotide
cctggactcaccggtgagtccagg

SEQ ID NO: 904 - DNA, 24 bp, Artificial Sequence
  Description of Artificial Sequence: Synthetic oligonucleotide
ccgtgactcaccggtgagtcacgg

SEQ ID NO: 905 - DNA, 24 bp, Artificial Sequence
  Description of Artificial Sequence: Synthetic oligonucleotide
cggcgactcaccggtgagtcgccg

SEQ ID NO: 906 - DNA, 24 bp, Artificial Sequence
  Description of Artificial Sequence: Synthetic oligonucleotide
cagcgactcaccggtgagtcgctg

SEQ ID NO: 907 - DNA, 24 bp, Artificial Sequence
  Description of Artificial Sequence: Synthetic oligonucleotide
cgacgactcaccggtgagtcgtcg

SEQ ID NO: 908 - DNA, 24 bp, Artificial Sequence
  Description of Artificial Sequence: Synthetic oligonucleotide
cggagactcaccggtgagtctccg

SEQ ID NO: 909 - DNA, 24 bp, Artificial Sequence
  Description of Artificial Sequence: Synthetic oligonucleotide
ctgcgactcaccggtgagtcgcag

SEQ ID NO: 910 - DNA, 24 bp, Artificial Sequence
  Description of Artificial Sequence: Synthetic oligonucleotide
cggtgactcaccggtgagtcaccg

SEQ ID NO: 911 - DNA, 24 bp, Artificial Sequence
  Description of Artificial Sequence: Synthetic oligonucleotide
cacggactcaccggtgagtccgtg

SEQ ID NO: 912 - DNA, 24 bp, Artificial Sequence
  Description of Artificial Sequence: Synthetic oligonucleotide
cccagactcaccggtgagtctggg

SEQ ID NO: 913 - DNA, 24 bp, Artificial Sequence
  Description of Artificial Sequence: Synthetic oligonucleotide
ctcggactcaccggtgagtccgag

SEQ ID NO: 914 - DNA, 24 bp, Artificial Sequence
  Description of Artificial Sequence: Synthetic oligonucleotide
ccctgactcaccggtgagtcaggg

SEQ ID NO: 915 - DNA, 24 bp, Artificial Sequence
  Description of Artificial Sequence: Synthetic oligonucleotide
ccacgactcaccggtgagtcgtgg

SEQ ID NO: 916 - DNA, 24 bp, Artificial Sequence
  Description of Artificial Sequence: Synthetic oligonucleotide
agccgactcaccggtgagtcggct

SEQ ID NO: 917 - DNA, 24 bp, Artificial Sequence
  Description of Artificial Sequence: Synthetic oligonucleotide
tgccgactcaccggtgagtcggca

SEQ ID NO: 918 - DNA, 24 bp, Artificial Sequence
  Description of Artificial Sequence: Synthetic oligonucleotide
gcgagactcaccggtgagtctcgc

SEQ ID NO: 919 - DNA, 24 bp, Artificial Sequence
  Description of Artificial Sequence: Synthetic oligonucleotide
gcgtgactcaccggtgagtcacgc

SEQ ID NO: 920 - DNA, 24 bp, Artificial Sequence
  Description of Artificial Sequence: Synthetic oligonucleotide
gcaggactcaccggtgagtcctgc

SEQ ID NO: 921 - DNA, 24 bp, Artificial Sequence
  Description of Artificial Sequence: Synthetic oligonucleotide
gctggactcaccggtgagtccagc

SEQ ID NO: 922 - DNA, 24 bp, Artificial Sequence
  Description of Artificial Sequence: Synthetic oligonucleotide
cgaggactcaccggtgagtcctcg

SEQ ID NO: 923 - DNA, 24 bp, Artificial Sequence
  Description of Artificial Sequence: Synthetic oligonucleotide
cgtggactcaccggtgagtccacg

SEQ ID NO: 924 - DNA, 24 bp, Artificial Sequence
  Description of Artificial Sequence: Synthetic oligonucleotide
caccgactcaccggtgagtcggtg

SEQ ID NO: 925 - DNA, 24 bp, Artificial Sequence
  Description of Artificial Sequence: Synthetic oligonucleotide
ctccgactcaccggtgagtcggag

SEQ ID NO: 926 - DNA, 24 bp, Artificial Sequence
  Description of Artificial Sequence: Synthetic oligonucleotide
gcgggactcaccggtgagtcccgc

SEQ ID NO: 927 - DNA, 24 bp, Artificial Sequence
  Description of Artificial Sequence: Synthetic oligonucleotide
gagggactcaccggtgagtccctc

SEQ ID NO: 928 - DNA, 24 bp, Artificial Sequence
  Description of Artificial Sequence: Synthetic oligonucleotide
gtgggactcaccggtgagtcccac

SEQ ID NO: 929 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcccatgggagtcnnnn

SEQ ID NO: 930 - DNA, 24 bp, Artificial Sequence
  Description of Artificial Sequence: Synthetic oligonucleotide
ggcggactcccatgggagtccgcc

SEQ ID NO: 931 - DNA, 24 bp, Artificial Sequence
  Description of Artificial Sequence: Synthetic oligonucleotide
agcggactcccatgggagtccgct

SEQ ID NO: 932 - DNA, 24 bp, Artificial Sequence
  Description of Artificial Sequence: Synthetic oligonucleotide
gacggactcccatgggagtccgtc

SEQ ID NO: 933 - DNA, 24 bp, Artificial Sequence
  Description of Artificial Sequence: Synthetic oligonucleotide
ggaggactcccatgggagtcctcc

SEQ ID NO: 934 - DNA, 24 bp, Artificial Sequence
  Description of Artificial Sequence: Synthetic oligonucleotide
ggcagactcccatgggagtctgcc

SEQ ID NO: 935 - DNA, 24 bp, Artificial Sequence
  Description of Artificial Sequence: Synthetic oligonucleotide
tgcggactcccatgggagtccgca

SEQ ID NO: 936 - DNA, 24 bp, Artificial Sequence
  Description of Artificial Sequence: Synthetic oligonucleotide
gtcggactcccatgggagtccgac

SEQ ID NO: 937 - DNA, 24 bp, Artificial Sequence
  Description of Artificial Sequence: Synthetic oligonucleotide
ggtggactcccatgggagtccacc

SEQ ID NO: 938 - DNA, 24 bp, Artificial Sequence
  Description of Artificial Sequence: Synthetic oligonucleotide
ggctgactcccatgggagtcagcc

SEQ ID NO: 939 - DNA, 24 bp, Artificial Sequence
  Description of Artificial Sequence: Synthetic oligonucleotide
gcccgactcccatgggagtcgggc

SEQ ID NO: 940 - DNA, 24 bp, Artificial Sequence
  Description of Artificial Sequence: Synthetic oligonucleotide
acccgactcccatgggagtcgggt

SEQ ID NO: 941 - DNA, 24 bp, Artificial Sequence
  Description of Artificial Sequence: Synthetic oligonucleotide
gaccgactcccatgggagtcggtc

SEQ ID NO: 942 - DNA, 24 bp, Artificial Sequence
  Description of Artificial Sequence: Synthetic oligonucleotide
gcacgactcccatgggagtcgtgc

SEQ ID NO: 943 - DNA, 24 bp, Artificial Sequence
  Description of Artificial Sequence: Synthetic oligonucleotide
gccagactcccatgggagtctggc

SEQ ID NO: 944 - DNA, 24 bp, Artificial Sequence
  Description of Artificial Sequence: Synthetic oligonucleotide
tcccgactcccatgggagtcggga

SEQ ID NO: 945 - DNA, 24 bp, Artificial Sequence
  Description of Artificial Sequence: Synthetic oligonucleotide
gtccgactcccatgggagtcggac

SEQ ID NO: 946 - DNA, 24 bp, Artificial Sequence
  Description of Artificial Sequence: Synthetic oligonucleotide
gcctgactcccatgggagtcaggc

SEQ ID NO: 947 - DNA, 24 bp, Artificial Sequence
  Description of Artificial Sequence: Synthetic oligonucleotide
gggcgactcccatgggagtcgccc

SEQ ID NO: 948 - DNA, 24 bp, Artificial Sequence
  Description of Artificial Sequence: Synthetic oligonucleotide
aggcgactcccatgggagtcgcct

SEQ ID NO: 949 - DNA, 24 bp, Artificial Sequence
  Description of Artificial Sequence: Synthetic oligonucleotide
gagcgactcccatgggagtcgctc

SEQ ID NO: 950 - DNA, 24 bp, Artificial Sequence
  Description of Artificial Sequence: Synthetic oligonucleotide
ggacgactcccatgggagtcgtcc

SEQ ID NO: 951 - DNA, 24 bp, Artificial Sequence
  Description of Artificial Sequence: Synthetic oligonucleotide
gggagactcccatgggagtctccc

SEQ ID NO: 952 - DNA, 24 bp, Artificial Sequence
  Description of Artificial Sequence: Synthetic oligonucleotide
tggcgactcccatgggagtcgcca

SEQ ID NO: 953 - DNA, 24 bp, Artificial Sequence
  Description of Artificial Sequence: Synthetic oligonucleotide
gtgcgactcccatgggagtcgcac

SEQ ID NO: 954 - DNA, 24 bp, Artificial Sequence
  Description of Artificial Sequence: Synthetic oligonucleotide
gggtgactcccatgggagtcaccc

SEQ ID NO: 955 - DNA, 24 bp, Artificial Sequence
  Description of Artificial Sequence: Synthetic oligonucleotide
acgggactcccatgggagtcccgt

SEQ ID NO: 956 - DNA, 24 bp, Artificial Sequence
  Description of Artificial Sequence: Synthetic oligonucleotide
cagggactcccatgggagtccctg

SEQ ID NO: 957 - DNA, 24 bp, Artificial Sequence
  Description of Artificial Sequence: Synthetic oligonucleotide
ccaggactcccatgggagtcctgg

SEQ ID NO: 958 - DNA, 24 bp, Artificial Sequence
  Description of Artificial Sequence: Synthetic oligonucleotide
ccgagactcccatgggagtctcgg

SEQ ID NO: 959 - DNA, 24 bp, Artificial Sequence
  Description of Artificial Sequence: Synthetic oligonucleotide
tcgggactcccatgggagtcccga

SEQ ID NO: 960 - DNA, 24 bp, Artificial Sequence
  Description of Artificial Sequence: Synthetic oligonucleotide
ctgggactcccatgggagtcccag

SEQ ID NO: 961 - DNA, 24 bp, Artificial Sequence
  Description of Artificial Sequence: Synthetic oligonucleotide
cctggactcccatgggagtccagg

SEQ ID NO: 962 - DNA, 24 bp, Artificial Sequence
  Description of Artificial Sequence: Synthetic oligonucleotide
ccgtgactcccatgggagtcacgg

SEQ ID NO: 963 - DNA, 24 bp, Artificial Sequence
  Description of Artificial Sequence: Synthetic oligonucleotide
cggcgactcccatgggagtcgccg

SEQ ID NO: 964 - DNA, 24 bp, Artificial Sequence
  Description of Artificial Sequence: Synthetic oligonucleotide
cagcgactcccatgggagtcgctg

SEQ ID NO: 965 - DNA, 24 bp, Artificial Sequence
  Description of Artificial Sequence: Synthetic oligonucleotide
cgacgactcccatgggagtcgtcg

SEQ ID NO: 966 - DNA, 24 bp, Artificial Sequence
  Description of Artificial Sequence: Synthetic oligonucleotide
cggagactcccatgggagtctccg

SEQ ID NO: 967 - DNA, 24 bp, Artificial Sequence
  Description of Artificial Sequence: Synthetic oligonucleotide
ctgcgactcccatgggagtcgcag

SEQ ID NO: 968 - DNA, 24 bp, Artificial Sequence
  Description of Artificial Sequence: Synthetic oligonucleotide
cggtgactcccatgggagtcaccg

SEQ ID NO: 969 - DNA, 24 bp, Artificial Sequence
  Description of Artificial Sequence: Synthetic oligonucleotide
cacggactcccatgggagtccgtg

SEQ ID NO: 970 - DNA, 24 bp, Artificial Sequence
  Description of Artificial Sequence: Synthetic oligonucleotide
cccagactcccatgggagtctggg

SEQ ID NO: 971 - DNA, 24 bp, Artificial Sequence
  Description of Artificial Sequence: Synthetic oligonucleotide
ctcggactcccatgggagtccgag

SEQ ID NO: 972 - DNA, 24 bp, Artificial Sequence
  Description of Artificial Sequence: Synthetic oligonucleotide
ccctgactcccatgggagtcaggg

SEQ ID NO: 973 - DNA, 24 bp, Artificial Sequence
  Description of Artificial Sequence: Synthetic oligonucleotide
ccacgactcccatgggagtcgtgg

SEQ ID NO: 974 - DNA, 24 bp, Artificial Sequence
  Description of Artificial Sequence: Synthetic oligonucleotide
agccgactcccatgggagtcggct

SEQ ID NO: 975 - DNA, 24 bp, Artificial Sequence
  Description of Artificial Sequence: Synthetic oligonucleotide
tgccgactcccatgggagtcggca

SEQ ID NO: 976 - DNA, 24 bp, Artificial Sequence
  Description of Artificial Sequence: Synthetic oligonucleotide
gcgagactcccatgggagtctcgc

SEQ ID NO: 977 - DNA, 24 bp, Artificial Sequence
  Description of Artificial Sequence: Synthetic oligonucleotide
gcgtgactcccatgggagtcacgc

SEQ ID NO: 978 - DNA, 24 bp, Artificial Sequence
  Description of Artificial Sequence: Synthetic oligonucleotide
gcaggactcccatgggagtcctgc

SEQ ID NO: 979 - DNA, 24 bp, Artificial Sequence
  Description of Artificial Sequence: Synthetic oligonucleotide
gctggactcccatgggagtccagc

SEQ ID NO: 980 - DNA, 24 bp, Artificial Sequence
  Description of Artificial Sequence: Synthetic oligonucleotide
cgaggactcccatgggagtcctcg

SEQ ID NO: 981 - DNA, 24 bp, Artificial Sequence
  Description of Artificial Sequence: Synthetic oligonucleotide
cgtggactcccatgggagtccacg

SEQ ID NO: 982 - DNA, 24 bp, Artificial Sequence
  Description of Artificial Sequence: Synthetic oligonucleotide
caccgactcccatgggagtcggtg

SEQ ID NO: 983 - DNA, 24 bp, Artificial Sequence
  Description of Artificial Sequence: Synthetic oligonucleotide
ctccgactcccatgggagtcggag

SEQ ID NO: 984 - DNA, 24 bp, Artificial Sequence
  Description of Artificial Sequence: Synthetic oligonucleotide
gcgggactcccatgggagtcccgc

SEQ ID NO: 985 - DNA, 24 bp, Artificial Sequence
  Description of Artificial Sequence: Synthetic oligonucleotide
gagggactcccatgggagtccctc

SEQ ID NO: 986 - DNA, 24 bp, Artificial Sequence
  Description of Artificial Sequence: Synthetic oligonucleotide
gtgggactcccatgggagtcccac

SEQ ID NO: 987 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccctagggagtcnnnn

SEQ ID NO: 988 - DNA, 24 bp, Artificial Sequence
  Description of Artificial Sequence: Synthetic oligonucleotide
ggcggactccctagggagtccgcc

SEQ ID NO: 989 - DNA, 24 bp, Artificial Sequence
  Description of Artificial Sequence: Synthetic oligonucleotide
agcggactccctagggagtccgct

SEQ ID NO: 990 - DNA, 24 bp, Artificial Sequence
  Description of Artificial Sequence: Synthetic oligonucleotide
gacggactccctagggagtccgtc

SEQ ID NO: 991 - DNA, 24 bp, Artificial Sequence
  Description of Artificial Sequence: Synthetic oligonucleotide
ggaggactccctagggagtcctcc

SEQ ID NO: 992 - DNA, 24 bp, Artificial Sequence
  Description of Artificial Sequence: Synthetic oligonucleotide
ggcagactccctagggagtctgcc

SEQ ID NO: 993 - DNA, 24 bp, Artificial Sequence
  Description of Artificial Sequence: Synthetic oligonucleotide
tgcggactccctagggagtccgca

SEQ ID NO: 994 - DNA, 24 bp, Artificial Sequence
  Description of Artificial Sequence: Synthetic oligonucleotide
gtcggactccctagggagtccgac

SEQ ID NO: 995 - DNA, 24 bp, Artificial Sequence
  Description of Artificial Sequence: Synthetic oligonucleotide
ggtggactccctagggagtccacc

SEQ ID NO: 996 - DNA, 24 bp, Artificial Sequence
  Description of Artificial Sequence: Synthetic oligonucleotide
ggctgactccctagggagtcagcc

SEQ ID NO: 997 - DNA, 24 bp, Artificial Sequence
  Description of Artificial Sequence: Synthetic oligonucleotide
gcccgactccctagggagtcgggc

SEQ ID NO: 998 - DNA, 24 bp, Artificial Sequence
  Description of Artificial Sequence: Synthetic oligonucleotide
acccgactccctagggagtcgggt

SEQ ID NO: 999 - DNA, 24 bp, Artificial Sequence
  Description of Artificial Sequence: Synthetic oligonucleotide
gaccgactccctagggagtcggtc

SEQ ID NO: 1000 - DNA, 24 bp, Artificial Sequence
  Description of Artificial Sequence: Synthetic oligonucleotide
gcacgactccctagggagtcgtgc

SEQ ID NO: 1001 - DNA, 24 bp, Artificial Sequence
  Description of Artificial Sequence: Synthetic oligonucleotide
gccagactccctagggagtctggc

SEQ ID NO: 1002 - DNA, 24 bp, Artificial Sequence
  Description of Artificial Sequence: Synthetic oligonucleotide
tcccgactccctagggagtcggga

SEQ ID NO: 1003 - DNA, 24 bp, Artificial Sequence
  Description of Artificial Sequence: Synthetic oligonucleotide
gtccgactccctagggagtcggac

SEQ ID NO: 1004 - DNA, 24 bp, Artificial Sequence
  Description of Artificial Sequence: Synthetic oligonucleotide
gcctgactccctagggagtcaggc

SEQ ID NO: 1005 - DNA, 24 bp, Artificial Sequence
  Description of Artificial Sequence: Synthetic oligonucleotide
gggcgactccctagggagtcgccc

SEQ ID NO: 1006 - DNA, 24 bp, Artificial Sequence
  Description of Artificial Sequence: Synthetic oligonucleotide
aggcgactccctagggagtcgcct

SEQ ID NO: 1007 - DNA, 24 bp, Artificial Sequence
  Description of Artificial Sequence: Synthetic oligonucleotide
gagcgactccctagggagtcgctc

SEQ ID NO: 1008 - DNA, 24 bp, Artificial Sequence
  Description of Artificial Sequence: Synthetic oligonucleotide
ggacgactccctagggagtcgtcc

SEQ ID NO: 1009 - DNA, 24 bp, Artificial Sequence
  Description of Artificial Sequence: Synthetic oligonucleotide
gggagactccctagggagtctccc

SEQ ID NO: 1010 - DNA, 24 bp, Artificial Sequence
  Description of Artificial Sequence: Synthetic oligonucleotide
tggcgactccctagggagtcgcca

SEQ ID NO: 1011 - DNA, 24 bp, Artificial Sequence
  Description of Artificial Sequence: Synthetic oligonucleotide
gtgcgactccctagggagtcgcac

SEQ ID NO: 1012 - DNA, 24 bp, Artificial Sequence
  Description of Artificial Sequence: Synthetic oligonucleotide
gggtgactccctagggagtcaccc

SEQ ID NO: 1013 - DNA, 24 bp, Artificial Sequence
  Description of Artificial Sequence: Synthetic oligonucleotide
acgggactccctagggagtcccgt

SEQ ID NO: 1014 - DNA, 24 bp, Artificial Sequence
  Description of Artificial Sequence: Synthetic oligonucleotide
cagggactccctagggagtccctg

SEQ ID NO: 1015 - DNA, 24 bp, Artificial Sequence
  Description of Artificial Sequence: Synthetic oligonucleotide
ccaggactccctagggagtcctgg

SEQ ID NO: 1016 - DNA, 24 bp, Artificial Sequence
  Description of Artificial Sequence: Synthetic oligonucleotide
ccgagactccctagggagtctcgg

SEQ ID NO: 1017 - DNA, 24 bp, Artificial Sequence
  Description of Artificial Sequence: Synthetic oligonucleotide
tcgggactccctagggagtcccga

SEQ ID NO: 1018 - DNA, 24 bp, Artificial Sequence
  Description of Artificial Sequence: Synthetic oligonucleotide
ctgggactccctagggagtcccag

SEQ ID NO: 1019 - DNA, 24 bp, Artificial Sequence
  Description of Artificial Sequence: Synthetic oligonucleotide
cctggactccctagggagtccagg

SEQ ID NO: 1020 - DNA, 24 bp, Artificial Sequence
  Description of Artificial Sequence: Synthetic oligonucleotide
ccgtgactccctagggagtcacgg

SEQ ID NO: 1021 - DNA, 24 bp, Artificial Sequence
  Description of Artificial Sequence: Synthetic oligonucleotide
cggcgactccctagggagtcgccg

SEQ ID NO: 1022 - DNA, 24 bp, Artificial Sequence
  Description of Artificial Sequence: Synthetic oligonucleotide
cagcgactccctagggagtcgctg

SEQ ID NO: 1023 - DNA, 24 bp, Artificial Sequence
  Description of Artificial Sequence: Synthetic oligonucleotide
cgacgactccctagggagtcgtcg

SEQ ID NO: 1024 - DNA, 24 bp, Artificial Sequence
  Description of Artificial Sequence: Synthetic oligonucleotide
cggagactccctagggagtctccg

SEQ ID NO: 1025 - DNA, 24 bp, Artificial Sequence
  Description of Artificial Sequence: Synthetic oligonucleotide
ctgcgactccctagggagtcgcag

SEQ ID NO: 1026 - DNA, 24 bp, Artificial Sequence
  Description of Artificial Sequence: Synthetic oligonucleotide
cggtgactccctagggagtcaccg

SEQ ID NO: 1027 - DNA, 24 bp, Artificial Sequence
  Description of Artificial Sequence: Synthetic oligonucleotide
cacggactccctagggagtccgtg

SEQ ID NO: 1028 - DNA, 24 bp, Artificial Sequence
  Description of Artificial Sequence: Synthetic oligonucleotide
cccagactccctagggagtctggg

SEQ ID NO: 1029 - DNA, 24 bp, Artificial Sequence
  Description of Artificial Sequence: Synthetic oligonucleotide
ctcggactccctagggagtccgag

SEQ ID NO: 1030 - DNA, 24 bp, Artificial Sequence
  Description of Artificial Sequence: Synthetic oligonucleotide
ccctgactccctagggagtcaggg

SEQ ID NO: 1031 - DNA, 24 bp, Artificial Sequence
  Description of Artificial Sequence: Synthetic oligonucleotide
ccacgactccctagggagtcgtgg

SEQ ID NO: 1032 - DNA, 24 bp, Artificial Sequence
  Description of Artificial Sequence: Synthetic oligonucleotide
agccgactccctagggagtcggct

SEQ ID NO: 1033 - DNA, 24 bp, Artificial Sequence
  Description of Artificial Sequence: Synthetic oligonucleotide
tgccgactccctagggagtcggca

SEQ ID NO: 1034 - DNA, 24 bp, Artificial Sequence
  Description of Artificial Sequence: Synthetic oligonucleotide
gcgagactccctagggagtctcgc

SEQ ID NO: 1035 - DNA, 24 bp, Artificial Sequence
  Description of Artificial Sequence: Synthetic oligonucleotide
gcgtgactccctagggagtcacgc

SEQ ID NO: 1036 - DNA, 24 bp, Artificial Sequence
  Description of Artificial Sequence: Synthetic oligonucleotide
gcaggactccctagggagtcctgc

SEQ ID NO: 1037 - DNA, 24 bp, Artificial Sequence
  Description of Artificial Sequence: Synthetic oligonucleotide
gctggactccctagggagtccagc

SEQ ID NO: 1038 - DNA, 24 bp, Artificial Sequence
  Description of Artificial Sequence: Synthetic oligonucleotide
cgaggactccctagggagtcctcg

SEQ ID NO: 1039 - DNA, 24 bp, Artificial Sequence
  Description of Artificial Sequence: Synthetic oligonucleotide
cgtggactccctagggagtccacg

SEQ ID NO: 1040 - DNA, 24 bp, Artificial Sequence
  Description of Artificial Sequence: Synthetic oligonucleotide
caccgactccctagggagtcggtg

SEQ ID NO: 1041 - DNA, 24 bp, Artificial Sequence
  Description of Artificial Sequence: Synthetic oligonucleotide
ctccgactccctagggagtcggag

SEQ ID NO: 1042 - DNA, 24 bp, Artificial Sequence
  Description of Artificial Sequence: Synthetic oligonucleotide
gcgggactccctagggagtcccgc

SEQ ID NO: 1043 - DNA, 24 bp, Artificial Sequence
  Description of Artificial Sequence: Synthetic oligonucleotide
gagggactccctagggagtccctc

SEQ ID NO: 1044 - DNA, 24 bp, Artificial Sequence
  Description of Artificial Sequence: Synthetic oligonucleotide
gtgggactccctagggagtcccac

SEQ ID NO: 1045 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcccgcgggagtcnnnn

SEQ ID NO: 1046 - DNA, 24 bp, Artificial Sequence
  Description of Artificial Sequence: Synthetic oligonucleotide
ggcggactcccgcgggagtccgcc

SEQ ID NO: 1047 - DNA, 24 bp, Artificial Sequence
  Description of Artificial Sequence: Synthetic oligonucleotide
agcggactcccgcgggagtccgct

SEQ ID NO: 1048 - DNA, 24 bp, Artificial Sequence
  Description of Artificial Sequence: Synthetic oligonucleotide
gacggactcccgcgggagtccgtc

SEQ ID NO: 1049 - DNA, 24 bp, Artificial Sequence
  Description of Artificial Sequence: Synthetic oligonucleotide
ggaggactcccgcgggagtcctcc

SEQ ID NO: 1050 - DNA, 24 bp, Artificial Sequence
  Description of Artificial Sequence: Synthetic oligonucleotide
ggcagactcccgcgggagtctgcc

SEQ ID NO: 1051 - DNA, 24 bp, Artificial Sequence
  Description of Artificial Sequence: Synthetic oligonucleotide
tgcggactcccgcgggagtccgca

SEQ ID NO: 1052 - DNA, 24 bp, Artificial Sequence
  Description of Artificial Sequence: Synthetic oligonucleotide
gtcggactcccgcgggagtccgac

SEQ ID NO: 1053 - DNA, 24 bp, Artificial Sequence
  Description of Artificial Sequence: Synthetic oligonucleotide
ggtggactcccgcgggagtccacc

SEQ ID NO: 1054 - DNA, 24 bp, Artificial Sequence
  Description of Artificial Sequence: Synthetic oligonucleotide
ggctgactcccgcgggagtcagcc

SEQ ID NO: 1055 - DNA, 24 bp, Artificial Sequence
  Description of Artificial Sequence: Synthetic oligonucleotide
gcccgactcccgcgggagtcgggc

SEQ ID NO: 1056 - DNA, 24 bp, Artificial Sequence
  Description of Artificial Sequence: Synthetic oligonucleotide
acccgactcccgcgggagtcgggt

SEQ ID NO: 1057 - DNA, 24 bp, Artificial Sequence
  Description of Artificial Sequence: Synthetic oligonucleotide
gaccgactcccgcgggagtcggtc

SEQ ID NO: 1058 - DNA, 24 bp, Artificial Sequence
  Description of Artificial Sequence: Synthetic oligonucleotide
gcacgactcccgcgggagtcgtgc

SEQ ID NO: 1059 - DNA, 24 bp, Artificial Sequence
  Description of Artificial Sequence: Synthetic oligonucleotide
gccagactcccgcgggagtctggc

SEQ ID NO: 1060 - DNA, 24 bp, Artificial Sequence
  Description of Artificial Sequence: Synthetic oligonucleotide
tcccgactcccgcgggagtcggga

SEQ ID NO: 1061 - DNA, 24 bp, Artificial Sequence
  Description of Artificial Sequence: Synthetic oligonucleotide
gtccgactcccgcgggagtcggac

SEQ ID NO: 1062 - DNA, 24 bp, Artificial Sequence
  Description of Artificial Sequence: Synthetic oligonucleotide
gcctgactcccgcgggagtcaggc

SEQ ID NO: 1063 - DNA, 24 bp, Artificial Sequence
  Description of Artificial Sequence: Synthetic oligonucleotide
gggcgactcccgcgggagtcgccc

SEQ ID NO: 1064 - DNA, 24 bp, Artificial Sequence
  Description of Artificial Sequence: Synthetic oligonucleotide
aggcgactcccgcgggagtcgcct

SEQ ID NO: 1065 - DNA, 24 bp, Artificial Sequence
  Description of Artificial Sequence: Synthetic oligonucleotide
gagcgactcccgcgggagtcgctc

SEQ ID NO: 1066 - DNA, 24 bp, Artificial Sequence
  Description of Artificial Sequence: Synthetic oligonucleotide
ggacgactcccgcgggagtcgtcc

SEQ ID NO: 1067 - DNA, 24 bp, Artificial Sequence
  Description of Artificial Sequence: Synthetic oligonucleotide
gggagactcccgcgggagtctccc

SEQ ID NO: 1068 - DNA, 24 bp, Artificial Sequence
  Description of Artificial Sequence: Synthetic oligonucleotide
tggcgactcccgcgggagtcgcca

SEQ ID NO: 1069 - DNA, 24 bp, Artificial Sequence
  Description of Artificial Sequence: Synthetic oligonucleotide
gtgcgactcccgcgggagtcgcac

SEQ ID NO: 1070 - DNA, 24 bp, Artificial Sequence
  Description of Artificial Sequence: Synthetic oligonucleotide
gggtgactcccgcgggagtcaccc

SEQ ID NO: 1071 - DNA, 24 bp, Artificial Sequence
  Description of Artificial Sequence: Synthetic oligonucleotide
acgggactcccgcgggagtcccgt

SEQ ID NO: 1072 - DNA, 24 bp, Artificial Sequence
  Description of Artificial Sequence: Synthetic oligonucleotide
cagggactcccgcgggagtccctg

SEQ ID NO: 1073 - DNA, 24 bp, Artificial Sequence
  Description of Artificial Sequence: Synthetic oligonucleotide
ccaggactcccgcgggagtcctgg

SEQ ID NO: 1074 - DNA, 24 bp, Artificial Sequence
  Description of Artificial Sequence: Synthetic oligonucleotide
ccgagactcccgcgggagtctcgg

SEQ ID NO: 1075 - DNA, 24 bp, Artificial Sequence
  Description of Artificial Sequence: Synthetic oligonucleotide
tcgggactcccgcgggagtcccga

SEQ ID NO: 1076 - DNA, 24 bp, Artificial Sequence
  Description of Artificial Sequence: Synthetic oligonucleotide
ctgggactcccgcgggagtcccag

SEQ ID NO: 1077 - DNA, 24 bp, Artificial Sequence
  Description of Artificial Sequence: Synthetic oligonucleotide
cctggactcccgcgggagtccagg

SEQ ID NO: 1078 - DNA, 24 bp, Artificial Sequence
  Description of Artificial Sequence: Synthetic oligonucleotide
ccgtgactcccgcgggagtcacgg

SEQ ID NO: 1079 - DNA, 24 bp, Artificial Sequence
  Description of Artificial Sequence: Synthetic oligonucleotide
cggcgactcccgcgggagtcgccg

SEQ ID NO: 1080 - DNA, 24 bp, Artificial Sequence
  Description of Artificial Sequence: Synthetic oligonucleotide
cagcgactcccgcgggagtcgctg

SEQ ID NO: 1081 - DNA, 24 bp, Artificial Sequence
  Description of Artificial Sequence: Synthetic oligonucleotide
cgacgactcccgcgggagtcgtcg

SEQ ID NO: 1082 - DNA, 24 bp, Artificial Sequence
  Description of Artificial Sequence: Synthetic oligonucleotide
cggagactcccgcgggagtctccg

SEQ ID NO: 1083 - DNA, 24 bp, Artificial Sequence
  Description of Artificial Sequence: Synthetic oligonucleotide
ctgcgactcccgcgggagtcgcag

SEQ ID NO: 1084 - DNA, 24 bp, Artificial Sequence
  Description of Artificial Sequence: Synthetic oligonucleotide
cggtgactcccgcgggagtcaccg

SEQ ID NO: 1085 - DNA, 24 bp, Artificial Sequence
  Description of Artificial Sequence: Synthetic oligonucleotide
cacggactcccgcgggagtccgtg

SEQ ID NO: 1086 - DNA, 24 bp, Artificial Sequence
  Description of Artificial Sequence: Synthetic oligonucleotide
cccagactcccgcgggagtctggg

SEQ ID NO: 1087 - DNA, 24 bp, Artificial Sequence
  Description of Artificial Sequence: Synthetic oligonucleotide
ctcggactcccgcgggagtccgag

SEQ ID NO: 1088 - DNA, 24 bp, Artificial Sequence
  Description of Artificial Sequence: Synthetic oligonucleotide
ccctgactcccgcgggagtcaggg

SEQ ID NO: 1089 - DNA, 24 bp, Artificial Sequence
  Description of Artificial Sequence: Synthetic oligonucleotide
ccacgactcccgcgggagtcgtgg

SEQ ID NO: 1090 - DNA, 24 bp, Artificial Sequence
  Description of Artificial Sequence: Synthetic oligonucleotide
agccgactcccgcgggagtcggct

SEQ ID NO: 1091 - DNA, 24 bp, Artificial Sequence
  Description of Artificial Sequence: Synthetic oligonucleotide
tgccgactcccgcgggagtcggca

SEQ ID NO: 1092 - DNA, 24 bp, Artificial Sequence
  Description of Artificial Sequence: Synthetic oligonucleotide
gcgagactcccgcgggagtctcgc

SEQ ID NO: 1093 - DNA, 24 bp, Artificial Sequence
  Description of Artificial Sequence: Synthetic oligonucleotide
gcgtgactcccgcgggagtcacgc

SEQ ID NO: 1094 - DNA, 24 bp, Artificial Sequence
  Description of Artificial Sequence: Synthetic oligonucleotide
gcaggactcccgcgggagtcctgc

SEQ ID NO: 1095 - DNA, 24 bp, Artificial Sequence
  Description of Artificial Sequence: Synthetic oligonucleotide
gctggactcccgcgggagtccagc

SEQ ID NO: 1096 - DNA, 24 bp, Artificial Sequence
  Description of Artificial Sequence: Synthetic oligonucleotide
cgaggactcccgcgggagtcctcg

SEQ ID NO: 1097 - DNA, 24 bp, Artificial Sequence
  Description of Artificial Sequence: Synthetic oligonucleotide
cgtggactcccgcgggagtccacg

SEQ ID NO: 1098 - DNA, 24 bp, Artificial Sequence
  Description of Artificial Sequence: Synthetic oligonucleotide
caccgactcccgcgggagtcggtg

SEQ ID NO: 1099 - DNA, 24 bp, Artificial Sequence
  Description of Artificial Sequence: Synthetic oligonucleotide
ctccgactcccgcgggagtcggag

SEQ ID NO: 1100 - DNA, 24 bp, Artificial Sequence
  Description of Artificial Sequence: Synthetic oligonucleotide
gcgggactcccgcgggagtcccgc

SEQ ID NO: 1101 - DNA, 24 bp, Artificial Sequence
  Description of Artificial Sequence: Synthetic oligonucleotide
gagggactcccgcgggagtccctc

SEQ ID NO: 1102 - DNA, 24 bp, Artificial Sequence
  Description of Artificial Sequence: Synthetic oligonucleotide
gtgggactcccgcgggagtcccac

SEQ ID NO: 1103 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccccggggagtcnnnn

SEQ ID NO: 1104 - DNA, 24 bp, Artificial Sequence
  Description of Artificial Sequence: Synthetic oligonucleotide
ggcggactccccggggagtccgcc

SEQ ID NO: 1105 - DNA, 24 bp, Artificial Sequence
  Description of Artificial Sequence: Synthetic oligonucleotide
agcggactccccggggagtccgct

SEQ ID NO: 1106 - DNA, 24 bp, Artificial Sequence
  Description of Artificial Sequence: Synthetic oligonucleotide
gacggactccccggggagtccgtc

SEQ ID NO: 1107 - DNA, 24 bp, Artificial Sequence
  Description of Artificial Sequence: Synthetic oligonucleotide
ggaggactccccggggagtcctcc

SEQ ID NO: 1108 - DNA, 24 bp, Artificial Sequence
  Description of Artificial Sequence: Synthetic oligonucleotide
ggcagactccccggggagtctgcc

SEQ ID NO: 1109 - DNA, 24 bp, Artificial Sequence
  Description of Artificial Sequence: Synthetic oligonucleotide
tgcggactccccggggagtccgca

SEQ ID NO: 1110 - DNA, 24 bp, Artificial Sequence
  Description of Artificial Sequence: Synthetic oligonucleotide
gtcggactccccggggagtccgac

SEQ ID NO: 1111 - DNA, 24 bp, Artificial Sequence
  Description of Artificial Sequence: Synthetic oligonucleotide
ggtggactccccggggagtccacc

SEQ ID NO: 1112 - DNA, 24 bp, Artificial Sequence
  Description of Artificial Sequence: Synthetic oligonucleotide
ggctgactccccggggagtcagcc

SEQ ID NO: 1113 - DNA, 24 bp, Artificial Sequence
  Description of Artificial Sequence: Synthetic oligonucleotide
gcccgactccccggggagtcgggc

SEQ ID NO: 1114 - DNA, 24 bp, Artificial Sequence
  Description of Artificial Sequence: Synthetic oligonucleotide
acccgactccccggggagtcgggt

SEQ ID NO: 1115 - DNA, 24 bp, Artificial Sequence
  Description of Artificial Sequence: Synthetic oligonucleotide
gaccgactccccggggagtcggtc

SEQ ID NO: 1116 - DNA, 24 bp, Artificial Sequence
  Description of Artificial Sequence: Synthetic oligonucleotide
gcacgactccccggggagtcgtgc

SEQ ID NO: 1117 - DNA, 24 bp, Artificial Sequence
  Description of Artificial Sequence: Synthetic oligonucleotide
gccagactccccggggagtctggc

SEQ ID NO: 1118 - DNA, 24 bp, Artificial Sequence
  Description of Artificial Sequence: Synthetic oligonucleotide
tcccgactccccggggagtcggga

SEQ ID NO: 1119 - DNA, 24 bp, Artificial Sequence
  Description of Artificial Sequence: Synthetic oligonucleotide
gtccgactccccggggagtcggac

SEQ ID NO: 1120 - DNA, 24 bp, Artificial Sequence
  Description of Artificial Sequence: Synthetic oligonucleotide
gcctgactccccggggagtcaggc

SEQ ID NO: 1121 - DNA, 24 bp, Artificial Sequence
  Description of Artificial Sequence: Synthetic oligonucleotide
gggcgactccccggggagtcgccc

SEQ ID NO: 1122 - DNA, 24 bp, Artificial Sequence
  Description of Artificial Sequence: Synthetic oligonucleotide
aggcgactccccggggagtcgcct

SEQ ID NO: 1123 - DNA, 24 bp, Artificial Sequence
  Description of Artificial Sequence: Synthetic oligonucleotide
gagcgactccccggggagtcgctc

SEQ ID NO: 1124 - DNA, 24 bp, Artificial Sequence
  Description of Artificial Sequence: Synthetic oligonucleotide
ggacgactccccggggagtcgtcc

SEQ ID NO: 1125 - DNA, 24 bp, Artificial Sequence
  Description of Artificial Sequence: Synthetic oligonucleotide
gggagactccccggggagtctccc

SEQ ID NO: 1126 - DNA, 24 bp, Artificial Sequence
  Description of Artificial Sequence: Synthetic oligonucleotide
tggcgactccccggggagtcgcca

SEQ ID NO: 1127 - DNA, 24 bp, Artificial Sequence
  Description of Artificial Sequence: Synthetic oligonucleotide
gtgcgactccccggggagtcgcac

SEQ ID NO: 1128 - DNA, 24 bp, Artificial Sequence
  Description of Artificial Sequence: Synthetic oligonucleotide
gggtgactccccggggagtcaccc

SEQ ID NO: 1129 - DNA, 24 bp, Artificial Sequence
  Description of Artificial Sequence: Synthetic oligonucleotide
acgggactccccggggagtcccgt

SEQ ID NO: 1130 - DNA, 24 bp, Artificial Sequence
  Description of Artificial Sequence: Synthetic oligonucleotide
cagggactccccggggagtccctg

SEQ ID NO: 1131 - DNA, 24 bp, Artificial Sequence
  Description of Artificial Sequence: Synthetic oligonucleotide
ccaggactccccggggagtcctgg

SEQ ID NO: 1132 - DNA, 24 bp, Artificial Sequence
  Description of Artificial Sequence: Synthetic oligonucleotide
ccgagactccccggggagtctcgg

SEQ ID NO: 1133 - DNA, 24 bp, Artificial Sequence
  Description of Artificial Sequence: Synthetic oligonucleotide
tcgggactccccggggagtcccga

SEQ ID NO: 1134 - DNA, 24 bp, Artificial Sequence
  Description of Artificial Sequence: Synthetic oligonucleotide
ctgggactccccggggagtcccag

SEQ ID NO: 1135 - DNA, 24 bp, Artificial Sequence
  Description of Artificial Sequence: Synthetic oligonucleotide
cctggactccccggggagtccagg

SEQ ID NO: 1136 - DNA, 24 bp, Artificial Sequence
  Description of Artificial Sequence: Synthetic oligonucleotide
ccgtgactccccggggagtcacgg

SEQ ID NO: 1137 - DNA, 24 bp, Artificial Sequence
  Description of Artificial Sequence: Synthetic oligonucleotide
cggcgactccccggggagtcgccg

SEQ ID NO: 1138 - DNA, 24 bp, Artificial Sequence
  Description of Artificial Sequence: Synthetic oligonucleotide
cagcgactccccggggagtcgctg

SEQ ID NO: 1139 - DNA, 24 bp, Artificial Sequence
  Description of Artificial Sequence: Synthetic oligonucleotide
cgacgactccccggggagtcgtcg

SEQ ID NO: 1140 - DNA, 24 bp, Artificial Sequence
  Description of Artificial Sequence: Synthetic oligonucleotide
cggagactccccggggagtctccg

SEQ ID NO: 1141 - DNA, 24 bp, Artificial Sequence
  Description of Artificial Sequence: Synthetic oligonucleotide
ctgcgactccccggggagtcgcag

SEQ ID NO: 1142 - DNA, 24 bp, Artificial Sequence
  Description of Artificial Sequence: Synthetic oligonucleotide
cggtgactccccggggagtcaccg

SEQ ID NO: 1143 - DNA, 24 bp, Artificial Sequence
  Description of Artificial Sequence: Synthetic oligonucleotide
cacggactccccggggagtccgtg

SEQ ID NO: 1144 - DNA, 24 bp, Artificial Sequence
  Description of Artificial Sequence: Synthetic oligonucleotide
cccagactccccggggagtctggg

SEQ ID NO: 1145 - DNA, 24 bp, Artificial Sequence
  Description of Artificial Sequence: Synthetic oligonucleotide
ctcggactccccggggagtccgag

SEQ ID NO: 1146 - DNA, 24 bp, Artificial Sequence
  Description of Artificial Sequence: Synthetic oligonucleotide
ccctgactccccggggagtcaggg

SEQ ID NO: 1147 - DNA, 24 bp, Artificial Sequence
  Description of Artificial Sequence: Synthetic oligonucleotide
ccacgactccccggggagtcgtgg

SEQ ID NO: 1148 - DNA, 24 bp, Artificial Sequence
  Description of Artificial Sequence: Synthetic oligonucleotide
agccgactccccggggagtcggct

SEQ ID NO: 1149 - DNA, 24 bp, Artificial Sequence
  Description of Artificial Sequence: Synthetic oligonucleotide
tgccgactccccggggagtcggca

SEQ ID NO: 1150 - DNA, 24 bp, Artificial Sequence
  Description of Artificial Sequence: Synthetic oligonucleotide
gcgagactccccggggagtctcgc

SEQ ID NO: 1151 - DNA, 24 bp, Artificial Sequence
  Description of Artificial Sequence: Synthetic oligonucleotide
gcgtgactccccggggagtcacgc

SEQ ID NO: 1152 - DNA, 24 bp, Artificial Sequence
  Description of Artificial Sequence: Synthetic oligonucleotide
gcaggactccccggggagtcctgc

SEQ ID NO: 1153 - DNA, 24 bp, Artificial Sequence
  Description of Artificial Sequence: Synthetic oligonucleotide
gctggactccccggggagtccagc

SEQ ID NO: 1154 - DNA, 24 bp, Artificial Sequence
  Description of Artificial Sequence: Synthetic oligonucleotide
cgaggactccccggggagtcctcg

SEQ ID NO: 1155 - DNA, 24 bp, Artificial Sequence
  Description of Artificial Sequence: Synthetic oligonucleotide
cgtggactccccggggagtccacg

SEQ ID NO: 1156 - DNA, 24 bp, Artificial Sequence
  Description of Artificial Sequence: Synthetic oligonucleotide
caccgactccccggggagtcggtg

SEQ ID NO: 1157 - DNA, 24 bp, Artificial Sequence
  Description of Artificial Sequence: Synthetic oligonucleotide
ctccgactccccggggagtcggag

SEQ ID NO: 1158 - DNA, 24 bp, Artificial Sequence
  Description of Artificial Sequence: Synthetic oligonucleotide
gcgggactccccggggagtcccgc

SEQ ID NO: 1159 - DNA, 24 bp, Artificial Sequence
  Description of Artificial Sequence: Synthetic oligonucleotide
gagggactccccggggagtccctc

SEQ ID NO: 1160 - DNA, 24 bp, Artificial Sequence
  Description of Artificial Sequence: Synthetic oligonucleotide
gtgggactccccggggagtcccac

SEQ ID NO: 1161 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgtatacgagtcnnnn

SEQ ID NO: 1162 - DNA, 24 bp, Artificial Sequence
  Description of Artificial Sequence: Synthetic oligonucleotide
ggcggactcgtatacgagtccgcc

SEQ ID NO: 1163 - DNA, 24 bp, Artificial Sequence
  Description of Artificial Sequence: Synthetic oligonucleotide
agcggactcgtatacgagtccgct

SEQ ID NO: 1164 - DNA, 24 bp, Artificial Sequence
  Description of Artificial Sequence: Synthetic oligonucleotide
gacggactcgtatacgagtccgtc

SEQ ID NO: 1165 - DNA, 24 bp, Artificial Sequence
  Description of Artificial Sequence: Synthetic oligonucleotide
ggaggactcgtatacgagtcctcc

SEQ ID NO: 1166 - DNA, 24 bp, Artificial Sequence
  Description of Artificial Sequence: Synthetic oligonucleotide
ggcagactcgtatacgagtctgcc

SEQ ID NO: 1167 - DNA, 24 bp, Artificial Sequence
  Description of Artificial Sequence: Synthetic oligonucleotide
tgcggactcgtatacgagtccgca

SEQ ID NO: 1168 - DNA, 24 bp, Artificial Sequence
  Description of Artificial Sequence: Synthetic oligonucleotide
gtcggactcgtatacgagtccgac

SEQ ID NO: 1169 - DNA, 24 bp, Artificial Sequence
  Description of Artificial Sequence: Synthetic oligonucleotide
ggtggactcgtatacgagtccacc

SEQ ID NO: 1170 - DNA, 24 bp, Artificial Sequence
  Description of Artificial Sequence: Synthetic oligonucleotide
ggctgactcgtatacgagtcagcc

SEQ ID NO: 1171 - DNA, 24 bp, Artificial Sequence
  Description of Artificial Sequence: Synthetic oligonucleotide
gcccgactcgtatacgagtcgggc

SEQ ID NO: 1172 - DNA, 24 bp, Artificial Sequence
  Description of Artificial Sequence: Synthetic oligonucleotide
acccgactcgtatacgagtcgggt

SEQ ID NO: 1173 - DNA, 24 bp, Artificial Sequence
  Description of Artificial Sequence: Synthetic oligonucleotide
gaccgactcgtatacgagtcggtc

SEQ ID NO: 1174 - DNA, 24 bp, Artificial Sequence
  Description of Artificial Sequence: Synthetic oligonucleotide
gcacgactcgtatacgagtcgtgc

SEQ ID NO: 1175 - DNA, 24 bp, Artificial Sequence
  Description of Artificial Sequence: Synthetic oligonucleotide
gccagactcgtatacgagtctggc

SEQ ID NO: 1176 - DNA, 24 bp, Artificial Sequence
  Description of Artificial Sequence: Synthetic oligonucleotide
tcccgactcgtatacgagtcggga

SEQ ID NO: 1177 - DNA, 24 bp, Artificial Sequence
  Description of Artificial Sequence: Synthetic oligonucleotide
gtccgactcgtatacgagtcggac

SEQ ID NO: 1178 - DNA, 24 bp, Artificial Sequence
  Description of Artificial Sequence: Synthetic oligonucleotide
gcctgactcgtatacgagtcaggc

SEQ ID NO: 1179 - DNA, 24 bp, Artificial Sequence
  Description of Artificial Sequence: Synthetic oligonucleotide
gggcgactcgtatacgagtcgccc

SEQ ID NO: 1180 - DNA, 24 bp, Artificial Sequence
  Description of Artificial Sequence: Synthetic oligonucleotide
aggcgactcgtatacgagtcgcct

SEQ ID NO: 1181 - DNA, 24 bp, Artificial Sequence
  Description of Artificial Sequence: Synthetic oligonucleotide
gagcgactcgtatacgagtcgctc

SEQ ID NO: 1182 - DNA, 24 bp, Artificial Sequence
  Description of Artificial Sequence: Synthetic oligonucleotide
ggacgactcgtatacgagtcgtcc

SEQ ID NO: 1183 - DNA, 24 bp, Artificial Sequence
  Description of Artificial Sequence: Synthetic oligonucleotide
gggagactcgtatacgagtctccc

SEQ ID NO: 1184 - DNA, 24 bp, Artificial Sequence
  Description of Artificial Sequence: Synthetic oligonucleotide
tggcgactcgtatacgagtcgcca

SEQ ID NO: 1185 - DNA, 24 bp, Artificial Sequence
  Description of Artificial Sequence: Synthetic oligonucleotide
gtgcgactcgtatacgagtcgcac

SEQ ID NO: 1186 - DNA, 24 bp, Artificial Sequence
  Description of Artificial Sequence: Synthetic oligonucleotide
gggtgactcgtatacgagtcaccc

SEQ ID NO: 1187 - DNA, 24 bp, Artificial Sequence
  Description of Artificial Sequence: Synthetic oligonucleotide
acgggactcgtatacgagtcccgt

SEQ ID NO: 1188 - DNA, 24 bp, Artificial Sequence
  Description of Artificial Sequence: Synthetic oligonucleotide
cagggactcgtatacgagtccctg

SEQ ID NO: 1189 - DNA, 24 bp, Artificial Sequence
  Description of Artificial Sequence: Synthetic oligonucleotide
ccaggactcgtatacgagtcctgg

SEQ ID NO: 1190 - DNA, 24 bp, Artificial Sequence
  Description of Artificial Sequence: Synthetic oligonucleotide
ccgagactcgtatacgagtctcgg

SEQ ID NO: 1191 - DNA, 24 bp, Artificial Sequence
  Description of Artificial Sequence: Synthetic oligonucleotide
tcgggactcgtatacgagtcccga

SEQ ID NO: 1192 - DNA, 24 bp, Artificial Sequence
  Description of Artificial Sequence: Synthetic oligonucleotide
ctgggactcgtatacgagtcccag

SEQ ID NO: 1193 - DNA, 24 bp, Artificial Sequence
  Description of Artificial Sequence: Synthetic oligonucleotide
cctggactcgtatacgagtccagg

SEQ ID NO: 1194 - DNA, 24 bp, Artificial Sequence
  Description of Artificial Sequence: Synthetic oligonucleotide
ccgtgactcgtatacgagtcacgg

SEQ ID NO: 1195 - DNA, 24 bp, Artificial Sequence
  Description of Artificial Sequence: Synthetic oligonucleotide
cggcgactcgtatacgagtcgccg

SEQ ID NO: 1196 - DNA, 24 bp, Artificial Sequence
  Description of Artificial Sequence: Synthetic oligonucleotide
cagcgactcgtatacgagtcgctg

SEQ ID NO: 1197 - DNA, 24 bp, Artificial Sequence
  Description of Artificial Sequence: Synthetic oligonucleotide
cgacgactcgtatacgagtcgtcg

SEQ ID NO: 1198 - DNA, 24 bp, Artificial Sequence
  Description of Artificial Sequence: Synthetic oligonucleotide
cggagactcgtatacgagtctccg

SEQ ID NO: 1199 - DNA, 24 bp, Artificial Sequence
  Description of Artificial Sequence: Synthetic oligonucleotide
ctgcgactcgtatacgagtcgcag

SEQ ID NO: 1200 - DNA, 24 bp, Artificial Sequence
  Description of Artificial Sequence: Synthetic oligonucleotide
cggtgactcgtatacgagtcaccg

SEQ ID NO: 1201 - DNA, 24 bp, Artificial Sequence
  Description of Artificial Sequence: Synthetic oligonucleotide
cacggactcgtatacgagtccgtg

SEQ ID NO: 1202 - DNA, 24 bp, Artificial Sequence
  Description of Artificial Sequence: Synthetic oligonucleotide
cccagactcgtatacgagtctggg

SEQ ID NO: 1203 - DNA, 24 bp, Artificial Sequence
  Description of Artificial Sequence: Synthetic oligonucleotide
ctcggactcgtatacgagtccgag

SEQ ID NO: 1204 - DNA, 24 bp, Artificial Sequence
  Description of Artificial Sequence: Synthetic oligonucleotide
ccctgactcgtatacgagtcaggg

SEQ ID NO: 1205 - DNA, 24 bp, Artificial Sequence
  Description of Artificial Sequence: Synthetic oligonucleotide
ccacgactcgtatacgagtcgtgg

SEQ ID NO: 1206 - DNA, 24 bp, Artificial Sequence
  Description of Artificial Sequence: Synthetic oligonucleotide
agccgactcgtatacgagtcggct

SEQ ID NO: 1207 - DNA, 24 bp, Artificial Sequence
  Description of Artificial Sequence: Synthetic oligonucleotide
tgccgactcgtatacgagtcggca

SEQ ID NO: 1208 - DNA, 24 bp, Artificial Sequence
  Description of Artificial Sequence: Synthetic oligonucleotide
gcgagactcgtatacgagtctcgc

SEQ ID NO: 1209 - DNA, 24 bp, Artificial Sequence
  Description of Artificial Sequence: Synthetic oligonucleotide
gcgtgactcgtatacgagtcacgc

SEQ ID NO: 1210 - DNA, 24 bp, Artificial Sequence
  Description of Artificial Sequence: Synthetic oligonucleotide
gcaggactcgtatacgagtcctgc

SEQ ID NO: 1211 - DNA, 24 bp, Artificial Sequence
  Description of Artificial Sequence: Synthetic oligonucleotide
gctggactcgtatacgagtccagc

SEQ ID NO: 1212 - DNA, 24 bp, Artificial Sequence
  Description of Artificial Sequence: Synthetic oligonucleotide
cgaggactcgtatacgagtcctcg

SEQ ID NO: 1213 - DNA, 24 bp, Artificial Sequence
  Description of Artificial Sequence: Synthetic oligonucleotide
cgtggactcgtatacgagtccacg

SEQ ID NO: 1214 - DNA, 24 bp, Artificial Sequence
  Description of Artificial Sequence: Synthetic oligonucleotide
caccgactcgtatacgagtcggtg

SEQ ID NO: 1215 - DNA, 24 bp, Artificial Sequence
  Description of Artificial Sequence: Synthetic oligonucleotide
ctccgactcgtatacgagtcggag

SEQ ID NO: 1216 - DNA, 24 bp, Artificial Sequence
  Description of Artificial Sequence: Synthetic oligonucleotide
gcgggactcgtatacgagtcccgc

SEQ ID NO: 1217 - DNA, 24 bp, Artificial Sequence
  Description of Artificial Sequence: Synthetic oligonucleotide
gagggactcgtatacgagtccctc

SEQ ID NO: 1218 - DNA, 24 bp, Artificial Sequence
  Description of Artificial Sequence: Synthetic oligonucleotide
gtgggactcgtatacgagtcccac

SEQ ID NO: 1219 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgttaacgagtcnnnn

SEQ ID NO: 1220 - DNA, 24 bp, Artificial Sequence
  Description of Artificial Sequence: Synthetic oligonucleotide
ggcggactcgttaacgagtccgcc

SEQ ID NO: 1221 - DNA, 24 bp, Artificial Sequence
  Description of Artificial Sequence: Synthetic oligonucleotide
agcggactcgttaacgagtccgct

SEQ ID NO: 1222 - DNA, 24 bp, Artificial Sequence
  Description of Artificial Sequence: Synthetic oligonucleotide
gacggactcgttaacgagtccgtc

SEQ ID NO: 1223 - DNA, 24 bp, Artificial Sequence
  Description of Artificial Sequence: Synthetic oligonucleotide
ggaggactcgttaacgagtcctcc

SEQ ID NO: 1224 - DNA, 24 bp, Artificial Sequence
  Description of Artificial Sequence: Synthetic oligonucleotide
ggcagactcgttaacgagtctgcc

SEQ ID NO: 1225 - DNA, 24 bp, Artificial Sequence
  Description of Artificial Sequence: Synthetic oligonucleotide
tgcggactcgttaacgagtccgca

SEQ ID NO: 1226 - DNA, 24 bp, Artificial Sequence
  Description of Artificial Sequence: Synthetic oligonucleotide
gtcggactcgttaacgagtccgac

SEQ ID NO: 1227 - DNA, 24 bp, Artificial Sequence
  Description of Artificial Sequence: Synthetic oligonucleotide
ggtggactcgttaacgagtccacc

SEQ ID NO: 1228 - DNA, 24 bp, Artificial Sequence
  Description of Artificial Sequence: Synthetic oligonucleotide
ggctgactcgttaacgagtcagcc

SEQ ID NO: 1229 - DNA, 24 bp, Artificial Sequence
  Description of Artificial Sequence: Synthetic oligonucleotide
gcccgactcgttaacgagtcgggc

SEQ ID NO: 1230 - DNA, 24 bp, Artificial Sequence
  Description of Artificial Sequence: Synthetic oligonucleotide
acccgactcgttaacgagtcgggt

SEQ ID NO: 1231 - DNA, 24 bp, Artificial Sequence
  Description of Artificial Sequence: Synthetic oligonucleotide
gaccgactcgttaacgagtcggtc

SEQ ID NO: 1232 - DNA, 24 bp, Artificial Sequence
  Description of Artificial Sequence: Synthetic oligonucleotide
gcacgactcgttaacgagtcgtgc

SEQ ID NO: 1233 - DNA, 24 bp, Artificial Sequence
  Description of Artificial Sequence: Synthetic oligonucleotide
gccagactcgttaacgagtctggc

SEQ ID NO: 1234 - DNA, 24 bp, Artificial Sequence
  Description of Artificial Sequence: Synthetic oligonucleotide
tcccgactcgttaacgagtcggga

SEQ ID NO: 1235 - DNA, 24 bp, Artificial Sequence
  Description of Artificial Sequence: Synthetic oligonucleotide
gtccgactcgttaacgagtcggac

SEQ ID NO: 1236 - DNA, 24 bp, Artificial Sequence
  Description of Artificial Sequence: Synthetic oligonucleotide
gcctgactcgttaacgagtcaggc

SEQ ID NO: 1237 - DNA, 24 bp, Artificial Sequence
  Description of Artificial Sequence: Synthetic oligonucleotide
gggcgactcgttaacgagtcgccc

SEQ ID NO: 1238 - DNA, 24 bp, Artificial Sequence
  Description of Artificial Sequence: Synthetic oligonucleotide
aggcgactcgttaacgagtcgcct

SEQ ID NO: 1239 - DNA, 24 bp, Artificial Sequence
  Description of Artificial Sequence: Synthetic oligonucleotide
gagcgactcgttaacgagtcgctc

SEQ ID NO: 1240 - DNA, 24 bp, Artificial Sequence
  Description of Artificial Sequence: Synthetic oligonucleotide
ggacgactcgttaacgagtcgtcc

SEQ ID NO: 1241 - DNA, 24 bp, Artificial Sequence
  Description of Artificial Sequence: Synthetic oligonucleotide
gggagactcgttaacgagtctccc

SEQ ID NO: 1242 - DNA, 24 bp, Artificial Sequence
  Description of Artificial Sequence: Synthetic oligonucleotide
tggcgactcgttaacgagtcgcca

SEQ ID NO: 1243 - DNA, 24 bp, Artificial Sequence
  Description of Artificial Sequence: Synthetic oligonucleotide
gtgcgactcgttaacgagtcgcac

SEQ ID NO: 1244 - DNA, 24 bp, Artificial Sequence
  Description of Artificial Sequence: Synthetic oligonucleotide
gggtgactcgttaacgagtcaccc

SEQ ID NO: 1245 - DNA, 24 bp, Artificial Sequence
  Description of Artificial Sequence: Synthetic oligonucleotide
acgggactcgttaacgagtcccgt

SEQ ID NO: 1246 - DNA, 24 bp, Artificial Sequence
  Description of Artificial Sequence: Synthetic oligonucleotide
cagggactcgttaacgagtccctg

SEQ ID NO: 1247 - DNA, 24 bp, Artificial Sequence
  Description of Artificial Sequence: Synthetic oligonucleotide
ccaggactcgttaacgagtcctgg

SEQ ID NO: 1248 - DNA, 24 bp, Artificial Sequence
  Description of Artificial Sequence: Synthetic oligonucleotide
ccgagactcgttaacgagtctcgg

SEQ ID NO: 1249 - DNA, 24 bp, Artificial Sequence
  Description of Artificial Sequence: Synthetic oligonucleotide
tcgggactcgttaacgagtcccga

SEQ ID NO: 1250 - DNA, 24 bp, Artificial Sequence
  Description of Artificial Sequence: Synthetic oligonucleotide
ctgggactcgttaacgagtcccag

SEQ ID NO: 1251 - DNA, 24 bp, Artificial Sequence
  Description of Artificial Sequence: Synthetic oligonucleotide
cctggactcgttaacgagtccagg

SEQ ID NO: 1252 - DNA, 24 bp, Artificial Sequence
  Description of Artificial Sequence: Synthetic oligonucleotide
ccgtgactcgttaacgagtcacgg

SEQ ID NO: 1253 - DNA, 24 bp, Artificial Sequence
  Description of Artificial Sequence: Synthetic oligonucleotide
cggcgactcgttaacgagtcgccg

SEQ ID NO: 1254 - DNA, 24 bp, Artificial Sequence
  Description of Artificial Sequence: Synthetic oligonucleotide
cagcgactcgttaacgagtcgctg

SEQ ID NO: 1255 - DNA, 24 bp, Artificial Sequence
  Description of Artificial Sequence: Synthetic oligonucleotide
cgacgactcgttaacgagtcgtcg

SEQ ID NO: 1256 - DNA, 24 bp, Artificial Sequence
  Description of Artificial Sequence: Synthetic oligonucleotide
cggagactcgttaacgagtctccg

SEQ ID NO: 1257 - DNA, 24 bp, Artificial Sequence
  Description of Artificial Sequence: Synthetic oligonucleotide
ctgcgactcgttaacgagtcgcag

SEQ ID NO: 1258 - DNA, 24 bp, Artificial Sequence
  Description of Artificial Sequence: Synthetic oligonucleotide
cggtgactcgttaacgagtcaccg

SEQ ID NO: 1259 - DNA, 24 bp, Artificial Sequence
  Description of Artificial Sequence: Synthetic oligonucleotide
cacggactcgttaacgagtccgtg

SEQ ID NO: 1260 - DNA, 24 bp, Artificial Sequence
  Description of Artificial Sequence: Synthetic oligonucleotide
cccagactcgttaacgagtctggg

SEQ ID NO: 1261 - DNA, 24 bp, Artificial Sequence
  Description of Artificial Sequence: Synthetic oligonucleotide
ctcggactcgttaacgagtccgag

SEQ ID NO: 1262 - DNA, 24 bp, Artificial Sequence
  Description of Artificial Sequence: Synthetic oligonucleotide
ccctgactcgttaacgagtcaggg

SEQ ID NO: 1263 - DNA, 24 bp, Artificial Sequence
  Description of Artificial Sequence: Synthetic oligonucleotide
ccacgactcgttaacgagtcgtgg

SEQ ID NO: 1264 - DNA, 24 bp, Artificial Sequence
  Description of Artificial Sequence: Synthetic oligonucleotide
agccgactcgttaacgagtcggct

SEQ ID NO: 1265 - DNA, 24 bp, Artificial Sequence
  Description of Artificial Sequence: Synthetic oligonucleotide
tgccgactcgttaacgagtcggca

SEQ ID NO: 1266 - DNA, 24 bp, Artificial Sequence
  Description of Artificial Sequence: Synthetic oligonucleotide
gcgagactcgttaacgagtctcgc

SEQ ID NO: 1267 - DNA, 24 bp, Artificial Sequence
  Description of Artificial Sequence: Synthetic oligonucleotide
gcgtgactcgttaacgagtcacgc

SEQ ID NO: 1268 - DNA, 24 bp, Artificial Sequence
  Description of Artificial Sequence: Synthetic oligonucleotide
gcaggactcgttaacgagtcctgc

SEQ ID NO: 1269 - DNA, 24 bp, Artificial Sequence
  Description of Artificial Sequence: Synthetic oligonucleotide
gctggactcgttaacgagtccagc

SEQ ID NO: 1270 - DNA, 24 bp, Artificial Sequence
  Description of Artificial Sequence: Synthetic oligonucleotide
cgaggactcgttaacgagtcctcg

SEQ ID NO: 1271 - DNA, 24 bp, Artificial Sequence
  Description of Artificial Sequence: Synthetic oligonucleotide
cgtggactcgttaacgagtccacg

SEQ ID NO: 1272 - DNA, 24 bp, Artificial Sequence
  Description of Artificial Sequence: Synthetic oligonucleotide
caccgactcgttaacgagtcggtg

SEQ ID NO: 1273 - DNA, 24 bp, Artificial Sequence
  Description of Artificial Sequence: Synthetic oligonucleotide
ctccgactcgttaacgagtcggag

SEQ ID NO: 1274 - DNA, 24 bp, Artificial Sequence
  Description of Artificial Sequence: Synthetic oligonucleotide
gcgggactcgttaacgagtcccgc

SEQ ID NO: 1275 - DNA, 24 bp, Artificial Sequence
  Description of Artificial Sequence: Synthetic oligonucleotide
gagggactcgttaacgagtccctc

SEQ ID NO: 1276 - DNA, 24 bp, Artificial Sequence
  Description of Artificial Sequence: Synthetic oligonucleotide
gtgggactcgttaacgagtcccac

SEQ ID NO: 1277 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgtgcacgagtcnnnn

SEQ ID NO: 1278 - DNA, 24 bp, Artificial Sequence
  Description of Artificial Sequence: Synthetic oligonucleotide
ggcggactcgtgcacgagtccgcc

SEQ ID NO: 1279 - DNA, 24 bp, Artificial Sequence
  Description of Artificial Sequence: Synthetic oligonucleotide
agcggactcgtgcacgagtccgct

SEQ ID NO: 1280 - DNA, 24 bp, Artificial Sequence
  Description of Artificial Sequence: Synthetic oligonucleotide
gacggactcgtgcacgagtccgtc

SEQ ID NO: 1281 - DNA, 24 bp, Artificial Sequence
  Description of Artificial Sequence: Synthetic oligonucleotide
ggaggactcgtgcacgagtcctcc

SEQ ID NO: 1282 - DNA, 24 bp, Artificial Sequence
  Description of Artificial Sequence: Synthetic oligonucleotide
ggcagactcgtgcacgagtctgcc

SEQ ID NO: 1283 - DNA, 24 bp, Artificial Sequence
  Description of Artificial Sequence: Synthetic oligonucleotide
tgcggactcgtgcacgagtccgca

SEQ ID NO: 1284 - DNA, 24 bp, Artificial Sequence
  Description of Artificial Sequence: Synthetic oligonucleotide
gtcggactcgtgcacgagtccgac

SEQ ID NO: 1285 - DNA, 24 bp, Artificial Sequence
  Description of Artificial Sequence: Synthetic oligonucleotide
ggtggactcgtgcacgagtccacc

SEQ ID NO: 1286 - DNA, 24 bp, Artificial Sequence
  Description of Artificial Sequence: Synthetic oligonucleotide
ggctgactcgtgcacgagtcagcc

SEQ ID NO: 1287 - DNA, 24 bp, Artificial Sequence
  Description of Artificial Sequence: Synthetic oligonucleotide
gcccgactcgtgcacgagtcgggc

SEQ ID NO: 1288 - DNA, 24 bp, Artificial Sequence
  Description of Artificial Sequence: Synthetic oligonucleotide
acccgactcgtgcacgagtcgggt

SEQ ID NO: 1289 - DNA, 24 bp, Artificial Sequence
  Description of Artificial Sequence: Synthetic oligonucleotide
gaccgactcgtgcacgagtcggtc

SEQ ID NO: 1290 - DNA, 24 bp, Artificial Sequence
  Description of Artificial Sequence: Synthetic oligonucleotide
gcacgactcgtgcacgagtcgtgc

SEQ ID NO: 1291 - DNA, 24 bp, Artificial Sequence
  Description of Artificial Sequence: Synthetic oligonucleotide
gccagactcgtgcacgagtctggc

SEQ ID NO: 1292 - DNA, 24 bp, Artificial Sequence
  Description of Artificial Sequence: Synthetic oligonucleotide
tcccgactcgtgcacgagtcggga

SEQ ID NO: 1293 - DNA, 24 bp, Artificial Sequence
  Description of Artificial Sequence: Synthetic oligonucleotide
gtccgactcgtgcacgagtcggac

SEQ ID NO: 1294 - DNA, 24 bp, Artificial Sequence
  Description of Artificial Sequence: Synthetic oligonucleotide
gcctgactcgtgcacgagtcaggc

SEQ ID NO: 1295 - DNA, 24 bp, Artificial Sequence
  Description of Artificial Sequence: Synthetic oligonucleotide
gggcgactcgtgcacgagtcgccc

SEQ ID NO: 1296 - DNA, 24 bp, Artificial Sequence
  Description of Artificial Sequence: Synthetic oligonucleotide
aggcgactcgtgcacgagtcgcct

SEQ ID NO: 1297 - DNA, 24 bp, Artificial Sequence
  Description of Artificial Sequence: Synthetic oligonucleotide
gagcgactcgtgcacgagtcgctc

SEQ ID NO: 1298 - DNA, 24 bp, Artificial Sequence
  Description of Artificial Sequence: Synthetic oligonucleotide
ggacgactcgtgcacgagtcgtcc

SEQ ID NO: 1299 - DNA, 24 bp, Artificial Sequence
  Description of Artificial Sequence: Synthetic oligonucleotide
gggagactcgtgcacgagtctccc

SEQ ID NO: 1300 - DNA, 24 bp, Artificial Sequence
  Description of Artificial Sequence: Synthetic oligonucleotide
tggcgactcgtgcacgagtcgcca

SEQ ID NO: 1301 - DNA, 24 bp, Artificial Sequence
  Description of Artificial Sequence: Synthetic oligonucleotide
gtgcgactcgtgcacgagtcgcac

SEQ ID NO: 1302 - DNA, 24 bp, Artificial Sequence
  Description of Artificial Sequence: Synthetic oligonucleotide
gggtgactcgtgcacgagtcaccc

SEQ ID NO: 1303 - DNA, 24 bp, Artificial Sequence
  Description of Artificial Sequence: Synthetic oligonucleotide
acgggactcgtgcacgagtcccgt

SEQ ID NO: 1304 - DNA, 24 bp, Artificial Sequence
  Description of Artificial Sequence: Synthetic oligonucleotide
cagggactcgtgcacgagtccctg

SEQ ID NO: 1305 - DNA, 24 bp, Artificial Sequence
  Description of Artificial Sequence: Synthetic oligonucleotide
ccaggactcgtgcacgagtcctgg

SEQ ID NO: 1306 - DNA, 24 bp, Artificial Sequence
  Description of Artificial Sequence: Synthetic oligonucleotide
ccgagactcgtgcacgagtctcgg

SEQ ID NO: 1307 - DNA, 24 bp, Artificial Sequence
  Description of Artificial Sequence: Synthetic oligonucleotide
tcgggactcgtgcacgagtcccga

SEQ ID NO: 1308 - DNA, 24 bp, Artificial Sequence
  Description of Artificial Sequence: Synthetic oligonucleotide
ctgggactcgtgcacgagtcccag

SEQ ID NO: 1309 - DNA, 24 bp, Artificial Sequence
  Description of Artificial Sequence: Synthetic oligonucleotide
cctggactcgtgcacgagtccagg

SEQ ID NO: 1310 - DNA, 24 bp, Artificial Sequence
  Description of Artificial Sequence: Synthetic oligonucleotide
ccgtgactcgtgcacgagtcacgg

SEQ ID NO: 1311 - DNA, 24 bp, Artificial Sequence
  Description of Artificial Sequence: Synthetic oligonucleotide
cggcgactcgtgcacgagtcgccg

SEQ ID NO: 1312 - DNA, 24 bp, Artificial Sequence
  Description of Artificial Sequence: Synthetic oligonucleotide
cagcgactcgtgcacgagtcgctg

SEQ ID NO: 1313 - DNA, 24 bp, Artificial Sequence
  Description of Artificial Sequence: Synthetic oligonucleotide
cgacgactcgtgcacgagtcgtcg

SEQ ID NO: 1314 - DNA, 24 bp, Artificial Sequence
  Description of Artificial Sequence: Synthetic oligonucleotide
cggagactcgtgcacgagtctccg

SEQ ID NO: 1315 - DNA, 24 bp, Artificial Sequence
  Description of Artificial Sequence: Synthetic oligonucleotide
ctgcgactcgtgcacgagtcgcag

SEQ ID NO: 1316 - DNA, 24 bp, Artificial Sequence
  Description of Artificial Sequence: Synthetic oligonucleotide
cggtgactcgtgcacgagtcaccg

SEQ ID NO: 1317 - DNA, 24 bp, Artificial Sequence
  Description of Artificial Sequence: Synthetic oligonucleotide
cacggactcgtgcacgagtccgtg

SEQ ID NO: 1318 - DNA, 24 bp, Artificial Sequence
  Description of Artificial Sequence: Synthetic oligonucleotide
cccagactcgtgcacgagtctggg

SEQ ID NO: 1319 - DNA, 24 bp, Artificial Sequence
  Description of Artificial Sequence: Synthetic oligonucleotide
ctcggactcgtgcacgagtccgag

SEQ ID NO: 1320 - DNA, 24 bp, Artificial Sequence
  Description of Artificial Sequence: Synthetic oligonucleotide
ccctgactcgtgcacgagtcaggg

SEQ ID NO: 1321 - DNA, 24 bp, Artificial Sequence
  Description of Artificial Sequence: Synthetic oligonucleotide
ccacgactcgtgcacgagtcgtgg

SEQ ID NO: 1322 - DNA, 24 bp, Artificial Sequence
  Description of Artificial Sequence: Synthetic oligonucleotide
agccgactcgtgcacgagtcggct

SEQ ID NO: 1323 - DNA, 24 bp, Artificial Sequence
  Description of Artificial Sequence: Synthetic oligonucleotide
tgccgactcgtgcacgagtcggca

SEQ ID NO: 1324 - DNA, 24 bp, Artificial Sequence
  Description of Artificial Sequence: Synthetic oligonucleotide
gcgagactcgtgcacgagtctcgc

SEQ ID NO: 1325 - DNA, 24 bp, Artificial Sequence
  Description of Artificial Sequence: Synthetic oligonucleotide
gcgtgactcgtgcacgagtcacgc

SEQ ID NO: 1326 - DNA, 24 bp, Artificial Sequence
  Description of Artificial Sequence: Synthetic oligonucleotide
gcaggactcgtgcacgagtcctgc

SEQ ID NO: 1327 - DNA, 24 bp, Artificial Sequence
  Description of Artificial Sequence: Synthetic oligonucleotide
gctggactcgtgcacgagtccagc

SEQ ID NO: 1328 - DNA, 24 bp, Artificial Sequence
  Description of Artificial Sequence: Synthetic oligonucleotide
cgaggactcgtgcacgagtcctcg

SEQ ID NO: 1329 - DNA, 24 bp, Artificial Sequence
  Description of Artificial Sequence: Synthetic oligonucleotide
cgtggactcgtgcacgagtccacg

SEQ ID NO: 1330 - DNA, 24 bp, Artificial Sequence
  Description of Artificial Sequence: Synthetic oligonucleotide
caccgactcgtgcacgagtcggtg

SEQ ID NO: 1331 - DNA, 24 bp, Artificial Sequence
  Description of Artificial Sequence: Synthetic oligonucleotide
ctccgactcgtgcacgagtcggag

SEQ ID NO: 1332 - DNA, 24 bp, Artificial Sequence
  Description of Artificial Sequence: Synthetic oligonucleotide
gcgggactcgtgcacgagtcccgc

SEQ ID NO: 1333 - DNA, 24 bp, Artificial Sequence
  Description of Artificial Sequence: Synthetic oligonucleotide
gagggactcgtgcacgagtccctc

SEQ ID NO: 1334 - DNA, 24 bp, Artificial Sequence
  Description of Artificial Sequence: Synthetic oligonucleotide
gtgggactcgtgcacgagtcccac

SEQ ID NO: 1335 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcgtcgacgagtcnnnn

SEQ ID NO: 1336 - DNA, 24 bp, Artificial Sequence
  Description of Artificial Sequence: Synthetic oligonucleotide
ggcggactcgtcgacgagtccgcc

SEQ ID NO: 1337 - DNA, 24 bp, Artificial Sequence
  Description of Artificial Sequence: Synthetic oligonucleotide
agcggactcgtcgacgagtccgct

SEQ ID NO: 1338 - DNA, 24 bp, Artificial Sequence
  Description of Artificial Sequence: Synthetic oligonucleotide
gacggactcgtcgacgagtccgtc

SEQ ID NO: 1339 - DNA, 24 bp, Artificial Sequence
  Description of Artificial Sequence: Synthetic oligonucleotide
ggaggactcgtcgacgagtcctcc

SEQ ID NO: 1340 - DNA, 24 bp, Artificial Sequence
  Description of Artificial Sequence: Synthetic oligonucleotide
ggcagactcgtcgacgagtctgcc

SEQ ID NO: 1341 - DNA, 24 bp, Artificial Sequence
  Description of Artificial Sequence: Synthetic oligonucleotide
tgcggactcgtcgacgagtccgca

SEQ ID NO: 1342 - DNA, 24 bp, Artificial Sequence
  Description of Artificial Sequence: Synthetic oligonucleotide
gtcggactcgtcgacgagtccgac

SEQ ID NO: 1343 - DNA, 24 bp, Artificial Sequence
  Description of Artificial Sequence: Synthetic oligonucleotide
ggtggactcgtcgacgagtccacc

SEQ ID NO: 1344 - DNA, 24 bp, Artificial Sequence
  Description of Artificial Sequence: Synthetic oligonucleotide
ggctgactcgtcgacgagtcagcc

SEQ ID NO: 1345 - DNA, 24 bp, Artificial Sequence
  Description of Artificial Sequence: Synthetic oligonucleotide
gcccgactcgtcgacgagtcgggc

SEQ ID NO: 1346 - DNA, 24 bp, Artificial Sequence
  Description of Artificial Sequence: Synthetic oligonucleotide
acccgactcgtcgacgagtcgggt

SEQ ID NO: 1347 - DNA, 24 bp, Artificial Sequence
  Description of Artificial Sequence: Synthetic oligonucleotide
gaccgactcgtcgacgagtcggtc

SEQ ID NO: 1348 - DNA, 24 bp, Artificial Sequence
  Description of Artificial Sequence: Synthetic oligonucleotide
gcacgactcgtcgacgagtcgtgc

SEQ ID NO: 1349 - DNA, 24 bp, Artificial Sequence
  Description of Artificial Sequence: Synthetic oligonucleotide
gccagactcgtcgacgagtctggc

SEQ ID NO: 1350 - DNA, 24 bp, Artificial Sequence
  Description of Artificial Sequence: Synthetic oligonucleotide
tcccgactcgtcgacgagtcggga

SEQ ID NO: 1351 - DNA, 24 bp, Artificial Sequence
  Description of Artificial Sequence: Synthetic oligonucleotide
gtccgactcgtcgacgagtcggac

SEQ ID NO: 1352 - DNA, 24 bp, Artificial Sequence
  Description of Artificial Sequence: Synthetic oligonucleotide
gcctgactcgtcgacgagtcaggc

SEQ ID NO: 1353 - DNA, 24 bp, Artificial Sequence
  Description of Artificial Sequence: Synthetic oligonucleotide
gggcgactcgtcgacgagtcgccc

SEQ ID NO: 1354 - DNA, 24 bp, Artificial Sequence
  Description of Artificial Sequence: Synthetic oligonucleotide
aggcgactcgtcgacgagtcgcct

SEQ ID NO: 1355 - DNA, 24 bp, Artificial Sequence
  Description of Artificial Sequence: Synthetic oligonucleotide
gagcgactcgtcgacgagtcgctc

SEQ ID NO: 1356 - DNA, 24 bp, Artificial Sequence
  Description of Artificial Sequence: Synthetic oligonucleotide
ggacgactcgtcgacgagtcgtcc

SEQ ID NO: 1357 - DNA, 24 bp, Artificial Sequence
  Description of Artificial Sequence: Synthetic oligonucleotide
gggagactcgtcgacgagtctccc

SEQ ID NO: 1358 - DNA, 24 bp, Artificial Sequence
  Description of Artificial Sequence: Synthetic oligonucleotide
tggcgactcgtcgacgagtcgcca

SEQ ID NO: 1359 - DNA, 24 bp, Artificial Sequence
  Description of Artificial Sequence: Synthetic oligonucleotide
gtgcgactcgtcgacgagtcgcac

SEQ ID NO: 1360 - DNA, 24 bp, Artificial Sequence
  Description of Artificial Sequence: Synthetic oligonucleotide
gggtgactcgtcgacgagtcaccc

SEQ ID NO: 1361 - DNA, 24 bp, Artificial Sequence
  Description of Artificial Sequence: Synthetic oligonucleotide
acgggactcgtcgacgagtcccgt

SEQ ID NO: 1362 - DNA, 24 bp, Artificial Sequence
  Description of Artificial Sequence: Synthetic oligonucleotide
cagggactcgtcgacgagtccctg

SEQ ID NO: 1363 - DNA, 24 bp, Artificial Sequence
  Description of Artificial Sequence: Synthetic oligonucleotide
ccaggactcgtcgacgagtcctgg

SEQ ID NO: 1364 - DNA, 24 bp, Artificial Sequence
  Description of Artificial Sequence: Synthetic oligonucleotide
ccgagactcgtcgacgagtctcgg

SEQ ID NO: 1365 - DNA, 24 bp, Artificial Sequence
  Description of Artificial Sequence: Synthetic oligonucleotide
tcgggactcgtcgacgagtcccga

SEQ ID NO: 1366 - DNA, 24 bp, Artificial Sequence
  Description of Artificial Sequence: Synthetic oligonucleotide
ctgggactcgtcgacgagtcccag

SEQ ID NO: 1367 - DNA, 24 bp, Artificial Sequence
  Description of Artificial Sequence: Synthetic oligonucleotide
cctggactcgtcgacgagtccagg

SEQ ID NO: 1368 - DNA, 24 bp, Artificial Sequence
  Description of Artificial Sequence: Synthetic oligonucleotide
ccgtgactcgtcgacgagtcacgg

SEQ ID NO: 1369 - DNA, 24 bp, Artificial Sequence
  Description of Artificial Sequence: Synthetic oligonucleotide
cggcgactcgtcgacgagtcgccg

SEQ ID NO: 1370 - DNA, 24 bp, Artificial Sequence
  Description of Artificial Sequence: Synthetic oligonucleotide
cagcgactcgtcgacgagtcgctg

SEQ ID NO: 1371 - DNA, 24 bp, Artificial Sequence
  Description of Artificial Sequence: Synthetic oligonucleotide
cgacgactcgtcgacgagtcgtcg

SEQ ID NO: 1372 - DNA, 24 bp, Artificial Sequence
  Description of Artificial Sequence: Synthetic oligonucleotide
cggagactcgtcgacgagtctccg

SEQ ID NO: 1373 - DNA, 24 bp, Artificial Sequence
  Description of Artificial Sequence: Synthetic oligonucleotide
ctgcgactcgtcgacgagtcgcag

SEQ ID NO: 1374 - DNA, 24 bp, Artificial Sequence
  Description of Artificial Sequence: Synthetic oligonucleotide
cggtgactcgtcgacgagtcaccg

SEQ ID NO: 1375 - DNA, 24 bp, Artificial Sequence
  Description of Artificial Sequence: Synthetic oligonucleotide
cacggactcgtcgacgagtccgtg

SEQ ID NO: 1376 - DNA, 24 bp, Artificial Sequence
  Description of Artificial Sequence: Synthetic oligonucleotide
cccagactcgtcgacgagtctggg

SEQ ID NO: 1377 - DNA, 24 bp, Artificial Sequence
  Description of Artificial Sequence: Synthetic oligonucleotide
ctcggactcgtcgacgagtccgag

SEQ ID NO: 1378 - DNA, 24 bp, Artificial Sequence
  Description of Artificial Sequence: Synthetic oligonucleotide
ccctgactcgtcgacgagtcaggg

SEQ ID NO: 1379 - DNA, 24 bp, Artificial Sequence
  Description of Artificial Sequence: Synthetic oligonucleotide
ccacgactcgtcgacgagtcgtgg

SEQ ID NO: 1380 - DNA, 24 bp, Artificial Sequence
  Description of Artificial Sequence: Synthetic oligonucleotide
agccgactcgtcgacgagtcggct

SEQ ID NO: 1381 - DNA, 24 bp, Artificial Sequence
  Description of Artificial Sequence: Synthetic oligonucleotide
tgccgactcgtcgacgagtcggca

SEQ ID NO: 1382 - DNA, 24 bp, Artificial Sequence
  Description of Artificial Sequence: Synthetic oligonucleotide
gcgagactcgtcgacgagtctcgc

SEQ ID NO: 1383 - DNA, 24 bp, Artificial Sequence
  Description of Artificial Sequence: Synthetic oligonucleotide
gcgtgactcgtcgacgagtcacgc

SEQ ID NO: 1384 - DNA, 24 bp, Artificial Sequence
  Description of Artificial Sequence: Synthetic oligonucleotide
gcaggactcgtcgacgagtcctgc

SEQ ID NO: 1385 - DNA, 24 bp, Artificial Sequence
  Description of Artificial Sequence: Synthetic oligonucleotide
gctggactcgtcgacgagtccagc

SEQ ID NO: 1386 - DNA, 24 bp, Artificial Sequence
  Description of Artificial Sequence: Synthetic oligonucleotide
cgaggactcgtcgacgagtcctcg

SEQ ID NO: 1387 - DNA, 24 bp, Artificial Sequence
  Description of Artificial Sequence: Synthetic oligonucleotide
cgtggactcgtcgacgagtccacg

SEQ ID NO: 1388 - DNA, 24 bp, Artificial Sequence
  Description of Artificial Sequence: Synthetic oligonucleotide
caccgactcgtcgacgagtcggtg

SEQ ID NO: 1389 - DNA, 24 bp, Artificial Sequence
  Description of Artificial Sequence: Synthetic oligonucleotide
ctccgactcgtcgacgagtcggag

SEQ ID NO: 1390 - DNA, 24 bp, Artificial Sequence
  Description of Artificial Sequence: Synthetic oligonucleotide
gcgggactcgtcgacgagtcccgc

SEQ ID NO: 1391 - DNA, 24 bp, Artificial Sequence
  Description of Artificial Sequence: Synthetic oligonucleotide
gagggactcgtcgacgagtccctc

SEQ ID NO: 1392 - DNA, 24 bp, Artificial Sequence
  Description of Artificial Sequence: Synthetic oligonucleotide
gtgggactcgtcgacgagtcccac

SEQ ID NO: 1393 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcctataggagtcnnnn

SEQ ID NO: 1394 - DNA, 24 bp, Artificial Sequence
  Description of Artificial Sequence: Synthetic oligonucleotide
ggcggactcctataggagtccgcc

SEQ ID NO: 1395 - DNA, 24 bp, Artificial Sequence
  Description of Artificial Sequence: Synthetic oligonucleotide
agcggactcctataggagtccgct

SEQ ID NO: 1396 - DNA, 24 bp, Artificial Sequence
  Description of Artificial Sequence: Synthetic oligonucleotide
gacggactcctataggagtccgtc

SEQ ID NO: 1397 - DNA, 24 bp, Artificial Sequence
  Description of Artificial Sequence: Synthetic oligonucleotide
ggaggactcctataggagtcctcc

SEQ ID NO: 1398 - DNA, 24 bp, Artificial Sequence
  Description of Artificial Sequence: Synthetic oligonucleotide
ggcagactcctataggagtctgcc

SEQ ID NO: 1399 - DNA, 24 bp, Artificial Sequence
  Description of Artificial Sequence: Synthetic oligonucleotide
tgcggactcctataggagtccgca

SEQ ID NO: 1400 - DNA, 24 bp, Artificial Sequence
  Description of Artificial Sequence: Synthetic oligonucleotide
gtcggactcctataggagtccgac

SEQ ID NO: 1401 - DNA, 24 bp, Artificial Sequence
  Description of Artificial Sequence: Synthetic oligonucleotide
ggtggactcctataggagtccacc

SEQ ID NO: 1402 - DNA, 24 bp, Artificial Sequence
  Description of Artificial Sequence: Synthetic oligonucleotide
ggctgactcctataggagtcagcc

SEQ ID NO: 1403 - DNA, 24 bp, Artificial Sequence
  Description of Artificial Sequence: Synthetic oligonucleotide
gcccgactcctataggagtcgggc

SEQ ID NO: 1404 - DNA, 24 bp, Artificial Sequence
  Description of Artificial Sequence: Synthetic oligonucleotide
acccgactcctataggagtcgggt

SEQ ID NO: 1405 - DNA, 24 bp, Artificial Sequence
  Description of Artificial Sequence: Synthetic oligonucleotide
gaccgactcctataggagtcggtc

SEQ ID NO: 1406 - DNA, 24 bp, Artificial Sequence
  Description of Artificial Sequence: Synthetic oligonucleotide
gcacgactcctataggagtcgtgc

SEQ ID NO: 1407 - DNA, 24 bp, Artificial Sequence
  Description of Artificial Sequence: Synthetic oligonucleotide
gccagactcctataggagtctggc

SEQ ID NO: 1408 - DNA, 24 bp, Artificial Sequence
  Description of Artificial Sequence: Synthetic oligonucleotide
tcccgactcctataggagtcggga

SEQ ID NO: 1409 - DNA, 24 bp, Artificial Sequence
  Description of Artificial Sequence: Synthetic oligonucleotide
gtccgactcctataggagtcggac

SEQ ID NO: 1410 - DNA, 24 bp, Artificial Sequence
  Description of Artificial Sequence: Synthetic oligonucleotide
gcctgactcctataggagtcaggc

SEQ ID NO: 1411 - DNA, 24 bp, Artificial Sequence
  Description of Artificial Sequence: Synthetic oligonucleotide
gggcgactcctataggagtcgccc

SEQ ID NO: 1412 - DNA, 24 bp, Artificial Sequence
  Description of Artificial Sequence: Synthetic oligonucleotide
aggcgactcctataggagtcgcct

SEQ ID NO: 1413 - DNA, 24 bp, Artificial Sequence
  Description of Artificial Sequence: Synthetic oligonucleotide
gagcgactcctataggagtcgctc

SEQ ID NO: 1414 - DNA, 24 bp, Artificial Sequence
  Description of Artificial Sequence: Synthetic oligonucleotide
ggacgactcctataggagtcgtcc

SEQ ID NO: 1415 - DNA, 24 bp, Artificial Sequence
  Description of Artificial Sequence: Synthetic oligonucleotide
gggagactcctataggagtctccc

SEQ ID NO: 1416 - DNA, 24 bp, Artificial Sequence
  Description of Artificial Sequence: Synthetic oligonucleotide
tggcgactcctataggagtcgcca

SEQ ID NO: 1417 - DNA, 24 bp, Artificial Sequence
  Description of Artificial Sequence: Synthetic oligonucleotide
gtgcgactcctataggagtcgcac

SEQ ID NO: 1418 - DNA, 24 bp, Artificial Sequence
  Description of Artificial Sequence: Synthetic oligonucleotide
gggtgactcctataggagtcaccc

SEQ ID NO: 1419 - DNA, 24 bp, Artificial Sequence
  Description of Artificial Sequence: Synthetic oligonucleotide
acgggactcctataggagtcccgt

SEQ ID NO: 1420 - DNA, 24 bp, Artificial Sequence
  Description of Artificial Sequence: Synthetic oligonucleotide
cagggactcctataggagtccctg

SEQ ID NO: 1421 - DNA, 24 bp, Artificial Sequence
  Description of Artificial Sequence: Synthetic oligonucleotide
ccaggactcctataggagtcctgg

SEQ ID NO: 1422 - DNA, 24 bp, Artificial Sequence
  Description of Artificial Sequence: Synthetic oligonucleotide
ccgagactcctataggagtctcgg

SEQ ID NO: 1423 - DNA, 24 bp, Artificial Sequence
  Description of Artificial Sequence: Synthetic oligonucleotide
tcgggactcctataggagtcccga

SEQ ID NO: 1424 - DNA, 24 bp, Artificial Sequence
  Description of Artificial Sequence: Synthetic oligonucleotide
ctgggactcctataggagtcccag

SEQ ID NO: 1425 - DNA, 24 bp, Artificial Sequence
  Description of Artificial Sequence: Synthetic oligonucleotide
cctggactcctataggagtccagg

SEQ ID NO: 1426 - DNA, 24 bp, Artificial Sequence
  Description of Artificial Sequence: Synthetic oligonucleotide
ccgtgactcctataggagtcacgg

SEQ ID NO: 1427 - DNA, 24 bp, Artificial Sequence
  Description of Artificial Sequence: Synthetic oligonucleotide
cggcgactcctataggagtcgccg

SEQ ID NO: 1428 - DNA, 24 bp, Artificial Sequence
  Description of Artificial Sequence: Synthetic oligonucleotide
cagcgactcctataggagtcgctg

SEQ ID NO: 1429 - DNA, 24 bp, Artificial Sequence
  Description of Artificial Sequence: Synthetic oligonucleotide
cgacgactcctataggagtcgtcg

SEQ ID NO: 1430 - DNA, 24 bp, Artificial Sequence
  Description of Artificial Sequence: Synthetic oligonucleotide
cggagactcctataggagtctccg

SEQ ID NO: 1431 - DNA, 24 bp, Artificial Sequence
  Description of Artificial Sequence: Synthetic oligonucleotide
ctgcgactcctataggagtcgcag

SEQ ID NO: 1432 - DNA, 24 bp, Artificial Sequence
  Description of Artificial Sequence: Synthetic oligonucleotide
cggtgactcctataggagtcaccg

SEQ ID NO: 1433 - DNA, 24 bp, Artificial Sequence
  Description of Artificial Sequence: Synthetic oligonucleotide
cacggactcctataggagtccgtg

SEQ ID NO: 1434 - DNA, 24 bp, Artificial Sequence
  Description of Artificial Sequence: Synthetic oligonucleotide
cccagactcctataggagtctggg

SEQ ID NO: 1435 - DNA, 24 bp, Artificial Sequence
  Description of Artificial Sequence: Synthetic oligonucleotide
ctcggactcctataggagtccgag

SEQ ID NO: 1436 - DNA, 24 bp, Artificial Sequence
  Description of Artificial Sequence: Synthetic oligonucleotide
ccctgactcctataggagtcaggg

SEQ ID NO: 1437 - DNA, 24 bp, Artificial Sequence
  Description of Artificial Sequence: Synthetic oligonucleotide
ccacgactcctataggagtcgtgg

SEQ ID NO: 1438 - DNA, 24 bp, Artificial Sequence
  Description of Artificial Sequence: Synthetic oligonucleotide
agccgactcctataggagtcggct

SEQ ID NO: 1439 - DNA, 24 bp, Artificial Sequence
  Description of Artificial Sequence: Synthetic oligonucleotide
tgccgactcctataggagtcggca

SEQ ID NO: 1440 - DNA, 24 bp, Artificial Sequence
  Description of Artificial Sequence: Synthetic oligonucleotide
gcgagactcctataggagtctcgc

SEQ ID NO: 1441 - DNA, 24 bp, Artificial Sequence
  Description of Artificial Sequence: Synthetic oligonucleotide
gcgtgactcctataggagtcacgc

SEQ ID NO: 1442 - DNA, 24 bp, Artificial Sequence
  Description of Artificial Sequence: Synthetic oligonucleotide
gcaggactcctataggagtcctgc

SEQ ID NO: 1443 - DNA, 24 bp, Artificial Sequence
  Description of Artificial Sequence: Synthetic oligonucleotide
gctggactcctataggagtccagc

SEQ ID NO: 1444 - DNA, 24 bp, Artificial Sequence
  Description of Artificial Sequence: Synthetic oligonucleotide
cgaggactcctataggagtcctcg

SEQ ID NO: 1445 - DNA, 24 bp, Artificial Sequence
  Description of Artificial Sequence: Synthetic oligonucleotide
cgtggactcctataggagtccacg

SEQ ID NO: 1446 - DNA, 24 bp, Artificial Sequence
  Description of Artificial Sequence: Synthetic oligonucleotide
caccgactcctataggagtcggtg

SEQ ID NO: 1447 - DNA, 24 bp, Artificial Sequence
  Description of Artificial Sequence: Synthetic oligonucleotide
ctccgactcctataggagtcggag

SEQ ID NO: 1448 - DNA, 24 bp, Artificial Sequence
  Description of Artificial Sequence: Synthetic oligonucleotide
gcgggactcctataggagtcccgc

SEQ ID NO: 1449 - DNA, 24 bp, Artificial Sequence
  Description of Artificial Sequence: Synthetic oligonucleotide
gagggactcctataggagtccctc

SEQ ID NO: 1450 - DNA, 24 bp, Artificial Sequence
  Description of Artificial Sequence: Synthetic oligonucleotide
gtgggactcctataggagtcccac

SEQ ID NO: 1451 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccttaaggagtcnnnn

SEQ ID NO: 1452 - DNA, 24 bp, Artificial Sequence
  Description of Artificial Sequence: Synthetic oligonucleotide
ggcggactccttaaggagtccgcc

SEQ ID NO: 1453 - DNA, 24 bp, Artificial Sequence
  Description of Artificial Sequence: Synthetic oligonucleotide
agcggactccttaaggagtccgct

SEQ ID NO: 1454 - DNA, 24 bp, Artificial Sequence
  Description of Artificial Sequence: Synthetic oligonucleotide
gacggactccttaaggagtccgtc

SEQ ID NO: 1455 - DNA, 24 bp, Artificial Sequence
  Description of Artificial Sequence: Synthetic oligonucleotide
ggaggactccttaaggagtcctcc

SEQ ID NO: 1456 - DNA, 24 bp, Artificial Sequence
  Description of Artificial Sequence: Synthetic oligonucleotide
ggcagactccttaaggagtctgcc

SEQ ID NO: 1457 - DNA, 24 bp, Artificial Sequence
  Description of Artificial Sequence: Synthetic oligonucleotide
tgcggactccttaaggagtccgca

SEQ ID NO: 1458 - DNA, 24 bp, Artificial Sequence
  Description of Artificial Sequence: Synthetic oligonucleotide
gtcggactccttaaggagtccgac

SEQ ID NO: 1459 - DNA, 24 bp, Artificial Sequence
  Description of Artificial Sequence: Synthetic oligonucleotide
ggtggactccttaaggagtccacc

SEQ ID NO: 1460 - DNA, 24 bp, Artificial Sequence
  Description of Artificial Sequence: Synthetic oligonucleotide
ggctgactccttaaggagtcagcc

SEQ ID NO: 1461 - DNA, 24 bp, Artificial Sequence
  Description of Artificial Sequence: Synthetic oligonucleotide
gcccgactccttaaggagtcgggc

SEQ ID NO: 1462 - DNA, 24 bp, Artificial Sequence
  Description of Artificial Sequence: Synthetic oligonucleotide
acccgactccttaaggagtcgggt

SEQ ID NO: 1463 - DNA, 24 bp, Artificial Sequence
  Description of Artificial Sequence: Synthetic oligonucleotide
gaccgactccttaaggagtcggtc

SEQ ID NO: 1464 - DNA, 24 bp, Artificial Sequence
  Description of Artificial Sequence: Synthetic oligonucleotide
gcacgactccttaaggagtcgtgc

SEQ ID NO: 1465 - DNA, 24 bp, Artificial Sequence
  Description of Artificial Sequence: Synthetic oligonucleotide
gccagactccttaaggagtctggc

SEQ ID NO: 1466 - DNA, 24 bp, Artificial Sequence
  Description of Artificial Sequence: Synthetic oligonucleotide
tcccgactccttaaggagtcggga

SEQ ID NO: 1467 - DNA, 24 bp, Artificial Sequence
  Description of Artificial Sequence: Synthetic oligonucleotide
gtccgactccttaaggagtcggac

SEQ ID NO: 1468 - DNA, 24 bp, Artificial Sequence
  Description of Artificial Sequence: Synthetic oligonucleotide
gcctgactccttaaggagtcaggc

SEQ ID NO: 1469 - DNA, 24 bp, Artificial Sequence
  Description of Artificial Sequence: Synthetic oligonucleotide
gggcgactccttaaggagtcgccc

SEQ ID NO: 1470 - DNA, 24 bp, Artificial Sequence
  Description of Artificial Sequence: Synthetic oligonucleotide
aggcgactccttaaggagtcgcct

SEQ ID NO: 1471 - DNA, 24 bp, Artificial Sequence
  Description of Artificial Sequence: Synthetic oligonucleotide
gagcgactccttaaggagtcgctc

SEQ ID NO: 1472 - DNA, 24 bp, Artificial Sequence
  Description of Artificial Sequence: Synthetic oligonucleotide
ggacgactccttaaggagtcgtcc

SEQ ID NO: 1473 - DNA, 24 bp, Artificial Sequence
  Description of Artificial Sequence: Synthetic oligonucleotide
gggagactccttaaggagtctccc

SEQ ID NO: 1474 - DNA, 24 bp, Artificial Sequence
  Description of Artificial Sequence: Synthetic oligonucleotide
tggcgactccttaaggagtcgcca

SEQ ID NO: 1475 - DNA, 24 bp, Artificial Sequence
  Description of Artificial Sequence: Synthetic oligonucleotide
gtgcgactccttaaggagtcgcac

SEQ ID NO: 1476 - DNA, 24 bp, Artificial Sequence
  Description of Artificial Sequence: Synthetic oligonucleotide
gggtgactccttaaggagtcaccc

SEQ ID NO: 1477 - DNA, 24 bp, Artificial Sequence
  Description of Artificial Sequence: Synthetic oligonucleotide
acgggactccttaaggagtcccgt

SEQ ID NO: 1478 - DNA, 24 bp, Artificial Sequence
  Description of Artificial Sequence: Synthetic oligonucleotide
cagggactccttaaggagtccctg

SEQ ID NO: 1479 - DNA, 24 bp, Artificial Sequence
  Description of Artificial Sequence: Synthetic oligonucleotide
ccaggactccttaaggagtcctgg

SEQ ID NO: 1480 - DNA, 24 bp, Artificial Sequence
  Description of Artificial Sequence: Synthetic oligonucleotide
ccgagactccttaaggagtctcgg

SEQ ID NO: 1481 - DNA, 24 bp, Artificial Sequence
  Description of Artificial Sequence: Synthetic oligonucleotide
tcgggactccttaaggagtcccga

SEQ ID NO: 1482 - DNA, 24 bp, Artificial Sequence
  Description of Artificial Sequence: Synthetic oligonucleotide
ctgggactccttaaggagtcccag

SEQ ID NO: 1483 - DNA, 24 bp, Artificial Sequence
  Description of Artificial Sequence: Synthetic oligonucleotide
cctggactccttaaggagtccagg

SEQ ID NO: 1484 - DNA, 24 bp, Artificial Sequence
  Description of Artificial Sequence: Synthetic oligonucleotide
ccgtgactccttaaggagtcacgg

SEQ ID NO: 1485 - DNA, 24 bp, Artificial Sequence
  Description of Artificial Sequence: Synthetic oligonucleotide
cggcgactccttaaggagtcgccg

SEQ ID NO: 1486 - DNA, 24 bp, Artificial Sequence
  Description of Artificial Sequence: Synthetic oligonucleotide
cagcgactccttaaggagtcgctg

SEQ ID NO: 1487 - DNA, 24 bp, Artificial Sequence
  Description of Artificial Sequence: Synthetic oligonucleotide
cgacgactccttaaggagtcgtcg

SEQ ID NO: 1488 - DNA, 24 bp, Artificial Sequence
  Description of Artificial Sequence: Synthetic oligonucleotide
cggagactccttaaggagtctccg

SEQ ID NO: 1489 - DNA, 24 bp, Artificial Sequence
  Description of Artificial Sequence: Synthetic oligonucleotide
ctgcgactccttaaggagtcgcag

SEQ ID NO: 1490 - DNA, 24 bp, Artificial Sequence
  Description of Artificial Sequence: Synthetic oligonucleotide
cggtgactccttaaggagtcaccg

SEQ ID NO: 1491 - DNA, 24 bp, Artificial Sequence
  Description of Artificial Sequence: Synthetic oligonucleotide
cacggactccttaaggagtccgtg

SEQ ID NO: 1492 - DNA, 24 bp, Artificial Sequence
  Description of Artificial Sequence: Synthetic oligonucleotide
cccagactccttaaggagtctggg

SEQ ID NO: 1493 - DNA, 24 bp, Artificial Sequence
  Description of Artificial Sequence: Synthetic oligonucleotide
ctcggactccttaaggagtccgag

SEQ ID NO: 1494 - DNA, 24 bp, Artificial Sequence
  Description of Artificial Sequence: Synthetic oligonucleotide
ccctgactccttaaggagtcaggg

SEQ ID NO: 1495 - DNA, 24 bp, Artificial Sequence
  Description of Artificial Sequence: Synthetic oligonucleotide
ccacgactccttaaggagtcgtgg

SEQ ID NO: 1496 - DNA, 24 bp, Artificial Sequence
  Description of Artificial Sequence: Synthetic oligonucleotide
agccgactccttaaggagtcggct

SEQ ID NO: 1497 - DNA, 24 bp, Artificial Sequence
  Description of Artificial Sequence: Synthetic oligonucleotide
tgccgactccttaaggagtcggca

SEQ ID NO: 1498 - DNA, 24 bp, Artificial Sequence
  Description of Artificial Sequence: Synthetic oligonucleotide
gcgagactccttaaggagtctcgc

SEQ ID NO: 1499 - DNA, 24 bp, Artificial Sequence
  Description of Artificial Sequence: Synthetic oligonucleotide
gcgtgactccttaaggagtcacgc

SEQ ID NO: 1500 - DNA, 24 bp, Artificial Sequence
  Description of Artificial Sequence: Synthetic oligonucleotide
gcaggactccttaaggagtcctgc

SEQ ID NO: 1501 - DNA, 24 bp, Artificial Sequence
  Description of Artificial Sequence: Synthetic oligonucleotide
gctggactccttaaggagtccagc

SEQ ID NO: 1502 - DNA, 24 bp, Artificial Sequence
  Description of Artificial Sequence: Synthetic oligonucleotide
cgaggactccttaaggagtcctcg

SEQ ID NO: 1503 - DNA, 24 bp, Artificial Sequence
  Description of Artificial Sequence: Synthetic oligonucleotide
cgtggactccttaaggagtccacg

SEQ ID NO: 1504 - DNA, 24 bp, Artificial Sequence
  Description of Artificial Sequence: Synthetic oligonucleotide
caccgactccttaaggagtcggtg

SEQ ID NO: 1505 - DNA, 24 bp, Artificial Sequence
  Description of Artificial Sequence: Synthetic oligonucleotide
ctccgactccttaaggagtcggag

SEQ ID NO: 1506 - DNA, 24 bp, Artificial Sequence
  Description of Artificial Sequence: Synthetic oligonucleotide
gcgggactccttaaggagtcccgc

SEQ ID NO: 1507 - DNA, 24 bp, Artificial Sequence
  Description of Artificial Sequence: Synthetic oligonucleotide
gagggactccttaaggagtccctc

SEQ ID NO: 1508 - DNA, 24 bp, Artificial Sequence
  Description of Artificial Sequence: Synthetic oligonucleotide
gtgggactccttaaggagtcccac

SEQ ID NO: 1509 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcctgcaggagtcnnnn

SEQ ID NO: 1510 - DNA, 24 bp, Artificial Sequence
  Description of Artificial Sequence: Synthetic oligonucleotide
ggcggactcctgcaggagtccgcc

SEQ ID NO: 1511 - DNA, 24 bp, Artificial Sequence
  Description of Artificial Sequence: Synthetic oligonucleotide
agcggactcctgcaggagtccgct

SEQ ID NO: 1512 - DNA, 24 bp, Artificial Sequence
  Description of Artificial Sequence: Synthetic oligonucleotide
gacggactcctgcaggagtccgtc

SEQ ID NO: 1513 - DNA, 24 bp, Artificial Sequence
  Description of Artificial Sequence: Synthetic oligonucleotide
ggaggactcctgcaggagtcctcc

SEQ ID NO: 1514 - DNA, 24 bp, Artificial Sequence
  Description of Artificial Sequence: Synthetic oligonucleotide
ggcagactcctgcaggagtctgcc

SEQ ID NO: 1515 - DNA, 24 bp, Artificial Sequence
  Description of Artificial Sequence: Synthetic oligonucleotide
tgcggactcctgcaggagtccgca

SEQ ID NO: 1516 - DNA, 24 bp, Artificial Sequence
  Description of Artificial Sequence: Synthetic oligonucleotide
gtcggactcctgcaggagtccgac

SEQ ID NO: 1517 - DNA, 24 bp, Artificial Sequence
  Description of Artificial Sequence: Synthetic oligonucleotide
ggtggactcctgcaggagtccacc

SEQ ID NO: 1518 - DNA, 24 bp, Artificial Sequence
  Description of Artificial Sequence: Synthetic oligonucleotide
ggctgactcctgcaggagtcagcc

SEQ ID NO: 1519 - DNA, 24 bp, Artificial Sequence
  Description of Artificial Sequence: Synthetic oligonucleotide
gcccgactcctgcaggagtcgggc

SEQ ID NO: 1520 - DNA, 24 bp, Artificial Sequence
  Description of Artificial Sequence: Synthetic oligonucleotide
acccgactcctgcaggagtcgggt

SEQ ID NO: 1521 - DNA, 24 bp, Artificial Sequence
  Description of Artificial Sequence: Synthetic oligonucleotide
gaccgactcctgcaggagtcggtc

SEQ ID NO: 1522 - DNA, 24 bp, Artificial Sequence
  Description of Artificial Sequence: Synthetic oligonucleotide
gcacgactcctgcaggagtcgtgc

SEQ ID NO: 1523 - DNA, 24 bp, Artificial Sequence
  Description of Artificial Sequence: Synthetic oligonucleotide
gccagactcctgcaggagtctggc

SEQ ID NO: 1524 - DNA, 24 bp, Artificial Sequence
  Description of Artificial Sequence: Synthetic oligonucleotide
tcccgactcctgcaggagtcggga

SEQ ID NO: 1525 - DNA, 24 bp, Artificial Sequence
  Description of Artificial Sequence: Synthetic oligonucleotide
gtccgactcctgcaggagtcggac

SEQ ID NO: 1526 - DNA, 24 bp, Artificial Sequence
  Description of Artificial Sequence: Synthetic oligonucleotide
gcctgactcctgcaggagtcaggc

SEQ ID NO: 1527 - DNA, 24 bp, Artificial Sequence
  Description of Artificial Sequence: Synthetic oligonucleotide
gggcgactcctgcaggagtcgccc

SEQ ID NO: 1528 - DNA, 24 bp, Artificial Sequence
  Description of Artificial Sequence: Synthetic oligonucleotide
aggcgactcctgcaggagtcgcct

SEQ ID NO: 1529 - DNA, 24 bp, Artificial Sequence
  Description of Artificial Sequence: Synthetic oligonucleotide
gagcgactcctgcaggagtcgctc

SEQ ID NO: 1530 - DNA, 24 bp, Artificial Sequence
  Description of Artificial Sequence: Synthetic oligonucleotide
ggacgactcctgcaggagtcgtcc

SEQ ID NO: 1531 - DNA, 24 bp, Artificial Sequence
  Description of Artificial Sequence: Synthetic oligonucleotide
gggagactcctgcaggagtctccc

SEQ ID NO: 1532 - DNA, 24 bp, Artificial Sequence
  Description of Artificial Sequence: Synthetic oligonucleotide
tggcgactcctgcaggagtcgcca

SEQ ID NO: 1533 - DNA, 24 bp, Artificial Sequence
  Description of Artificial Sequence: Synthetic oligonucleotide
gtgcgactcctgcaggagtcgcac

SEQ ID NO: 1534 - DNA, 24 bp, Artificial Sequence
  Description of Artificial Sequence: Synthetic oligonucleotide
gggtgactcctgcaggagtcaccc

SEQ ID NO: 1535 - DNA, 24 bp, Artificial Sequence
  Description of Artificial Sequence: Synthetic oligonucleotide
acgggactcctgcaggagtcccgt

SEQ ID NO: 1536 - DNA, 24 bp, Artificial Sequence
  Description of Artificial Sequence: Synthetic oligonucleotide
cagggactcctgcaggagtccctg

SEQ ID NO: 1537 - DNA, 24 bp, Artificial Sequence
  Description of Artificial Sequence: Synthetic oligonucleotide
ccaggactcctgcaggagtcctgg

SEQ ID NO: 1538 - DNA, 24 bp, Artificial Sequence
  Description of Artificial Sequence: Synthetic oligonucleotide
ccgagactcctgcaggagtctcgg

SEQ ID NO: 1539 - DNA, 24 bp, Artificial Sequence
  Description of Artificial Sequence: Synthetic oligonucleotide
tcgggactcctgcaggagtcccga

SEQ ID NO: 1540 - DNA, 24 bp, Artificial Sequence
  Description of Artificial Sequence: Synthetic oligonucleotide
ctgggactcctgcaggagtcccag

SEQ ID NO: 1541 - DNA, 24 bp, Artificial Sequence
  Description of Artificial Sequence: Synthetic oligonucleotide
cctggactcctgcaggagtccagg

SEQ ID NO: 1542 - DNA, 24 bp, Artificial Sequence
  Description of Artificial Sequence: Synthetic oligonucleotide
ccgtgactcctgcaggagtcacgg

SEQ ID NO: 1543 - DNA, 24 bp, Artificial Sequence
  Description of Artificial Sequence: Synthetic oligonucleotide
cggcgactcctgcaggagtcgccg

SEQ ID NO: 1544 - DNA, 24 bp, Artificial Sequence
  Description of Artificial Sequence: Synthetic oligonucleotide
cagcgactcctgcaggagtcgctg

SEQ ID NO: 1545 - DNA, 24 bp, Artificial Sequence
  Description of Artificial Sequence: Synthetic oligonucleotide
cgacgactcctgcaggagtcgtcg

SEQ ID NO: 1546 - DNA, 24 bp, Artificial Sequence
  Description of Artificial Sequence: Synthetic oligonucleotide
cggagactcctgcaggagtctccg

SEQ ID NO: 1547 - DNA, 24 bp, Artificial Sequence
  Description of Artificial Sequence: Synthetic oligonucleotide
ctgcgactcctgcaggagtcgcag

SEQ ID NO: 1548 - DNA, 24 bp, Artificial Sequence
  Description of Artificial Sequence: Synthetic oligonucleotide
cggtgactcctgcaggagtcaccg

SEQ ID NO: 1549 - DNA, 24 bp, Artificial Sequence
  Description of Artificial Sequence: Synthetic oligonucleotide
cacggactcctgcaggagtccgtg

SEQ ID NO: 1550 - DNA, 24 bp, Artificial Sequence
  Description of Artificial Sequence: Synthetic oligonucleotide
cccagactcctgcaggagtctggg

SEQ ID NO: 1551 - DNA, 24 bp, Artificial Sequence
  Description of Artificial Sequence: Synthetic oligonucleotide
ctcggactcctgcaggagtccgag

SEQ ID NO: 1552 - DNA, 24 bp, Artificial Sequence
  Description of Artificial Sequence: Synthetic oligonucleotide
ccctgactcctgcaggagtcaggg

SEQ ID NO: 1553 - DNA, 24 bp, Artificial Sequence
  Description of Artificial Sequence: Synthetic oligonucleotide
ccacgactcctgcaggagtcgtgg

SEQ ID NO: 1554 - DNA, 24 bp, Artificial Sequence
  Description of Artificial Sequence: Synthetic oligonucleotide
agccgactcctgcaggagtcggct

SEQ ID NO: 1555 - DNA, 24 bp, Artificial Sequence
  Description of Artificial Sequence: Synthetic oligonucleotide
tgccgactcctgcaggagtcggca

SEQ ID NO: 1556 - DNA, 24 bp, Artificial Sequence
  Description of Artificial Sequence: Synthetic oligonucleotide
gcgagactcctgcaggagtctcgc

SEQ ID NO: 1557 - DNA, 24 bp, Artificial Sequence
  Description of Artificial Sequence: Synthetic oligonucleotide
gcgtgactcctgcaggagtcacgc

SEQ ID NO: 1558 - DNA, 24 bp, Artificial Sequence
  Description of Artificial Sequence: Synthetic oligonucleotide
gcaggactcctgcaggagtcctgc

SEQ ID NO: 1559 - DNA, 24 bp, Artificial Sequence
  Description of Artificial Sequence: Synthetic oligonucleotide
gctggactcctgcaggagtccagc

SEQ ID NO: 1560 - DNA, 24 bp, Artificial Sequence
  Description of Artificial Sequence: Synthetic oligonucleotide
cgaggactcctgcaggagtcctcg

SEQ ID NO: 1561 - DNA, 24 bp, Artificial Sequence
  Description of Artificial Sequence: Synthetic oligonucleotide
cgtggactcctgcaggagtccacg

SEQ ID NO: 1562 - DNA, 24 bp, Artificial Sequence
  Description of Artificial Sequence: Synthetic oligonucleotide
caccgactcctgcaggagtcggtg

SEQ ID NO: 1563 - DNA, 24 bp, Artificial Sequence
  Description of Artificial Sequence: Synthetic oligonucleotide
ctccgactcctgcaggagtcggag

SEQ ID NO: 1564 - DNA, 24 bp, Artificial Sequence
  Description of Artificial Sequence: Synthetic oligonucleotide
gcgggactcctgcaggagtcccgc

SEQ ID NO: 1565 - DNA, 24 bp, Artificial Sequence
  Description of Artificial Sequence: Synthetic oligonucleotide
gagggactcctgcaggagtccctc

SEQ ID NO: 1566 - DNA, 24 bp, Artificial Sequence
  Description of Artificial Sequence: Synthetic oligonucleotide
gtgggactcctgcaggagtcccac

SEQ ID NO: 1567 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcctcgaggagtcnnnn

SEQ ID NO: 1568 - DNA, 24 bp, Artificial Sequence
  Description of Artificial Sequence: Synthetic oligonucleotide
ggcggactcctcgaggagtccgcc

SEQ ID NO: 1569 - DNA, 24 bp, Artificial Sequence
  Description of Artificial Sequence: Synthetic oligonucleotide
agcggactcctcgaggagtccgct

SEQ ID NO: 1570 - DNA, 24 bp, Artificial Sequence
  Description of Artificial Sequence: Synthetic oligonucleotide
gacggactcctcgaggagtccgtc

SEQ ID NO: 1571 - DNA, 24 bp, Artificial Sequence
  Description of Artificial Sequence: Synthetic oligonucleotide
ggaggactcctcgaggagtcctcc

SEQ ID NO: 1572 - DNA, 24 bp, Artificial Sequence
  Description of Artificial Sequence: Synthetic oligonucleotide
ggcagactcctcgaggagtctgcc

SEQ ID NO: 1573 - DNA, 24 bp, Artificial Sequence
  Description of Artificial Sequence: Synthetic oligonucleotide
tgcggactcctcgaggagtccgca

SEQ ID NO: 1574 - DNA, 24 bp, Artificial Sequence
  Description of Artificial Sequence: Synthetic oligonucleotide
gtcggactcctcgaggagtccgac

SEQ ID NO: 1575 - DNA, 24 bp, Artificial Sequence
  Description of Artificial Sequence: Synthetic oligonucleotide
ggtggactcctcgaggagtccacc

SEQ ID NO: 1576 - DNA, 24 bp, Artificial Sequence
  Description of Artificial Sequence: Synthetic oligonucleotide
ggctgactcctcgaggagtcagcc

SEQ ID NO: 1577 - DNA, 24 bp, Artificial Sequence
  Description of Artificial Sequence: Synthetic oligonucleotide
gcccgactcctcgaggagtcgggc

SEQ ID NO: 1578 - DNA, 24 bp, Artificial Sequence
  Description of Artificial Sequence: Synthetic oligonucleotide
acccgactcctcgaggagtcgggt

SEQ ID NO: 1579 - DNA, 24 bp, Artificial Sequence
  Description of Artificial Sequence: Synthetic oligonucleotide
gaccgactcctcgaggagtcggtc

SEQ ID NO: 1580 - DNA, 24 bp, Artificial Sequence
  Description of Artificial Sequence: Synthetic oligonucleotide
gcacgactcctcgaggagtcgtgc

SEQ ID NO: 1581 - DNA, 24 bp, Artificial Sequence
  Description of Artificial Sequence: Synthetic oligonucleotide
gccagactcctcgaggagtctggc

SEQ ID NO: 1582 - DNA, 24 bp, Artificial Sequence
  Description of Artificial Sequence: Synthetic oligonucleotide
tcccgactcctcgaggagtcggga

SEQ ID NO: 1583 - DNA, 24 bp, Artificial Sequence
  Description of Artificial Sequence: Synthetic oligonucleotide
gtccgactcctcgaggagtcggac

SEQ ID NO: 1584 - DNA, 24 bp, Artificial Sequence
  Description of Artificial Sequence: Synthetic oligonucleotide
gcctgactcctcgaggagtcaggc

SEQ ID NO: 1585 - DNA, 24 bp, Artificial Sequence
  Description of Artificial Sequence: Synthetic oligonucleotide
gggcgactcctcgaggagtcgccc

SEQ ID NO: 1586 - DNA, 24 bp, Artificial Sequence
  Description of Artificial Sequence: Synthetic oligonucleotide
aggcgactcctcgaggagtcgcct

SEQ ID NO: 1587 - DNA, 24 bp, Artificial Sequence
  Description of Artificial Sequence: Synthetic oligonucleotide
gagcgactcctcgaggagtcgctc

SEQ ID NO: 1588 - DNA, 24 bp, Artificial Sequence
  Description of Artificial Sequence: Synthetic oligonucleotide
ggacgactcctcgaggagtcgtcc

SEQ ID NO: 1589 - DNA, 24 bp, Artificial Sequence
  Description of Artificial Sequence: Synthetic oligonucleotide
gggagactcctcgaggagtctccc

SEQ ID NO: 1590 - DNA, 24 bp, Artificial Sequence
  Description of Artificial Sequence: Synthetic oligonucleotide
tggcgactcctcgaggagtcgcca

SEQ ID NO: 1591 - DNA, 24 bp, Artificial Sequence
  Description of Artificial Sequence: Synthetic oligonucleotide
gtgcgactcctcgaggagtcgcac

SEQ ID NO: 1592 - DNA, 24 bp, Artificial Sequence
  Description of Artificial Sequence: Synthetic oligonucleotide
gggtgactcctcgaggagtcaccc

SEQ ID NO: 1593 - DNA, 24 bp, Artificial Sequence
  Description of Artificial Sequence: Synthetic oligonucleotide
acgggactcctcgaggagtcccgt

SEQ ID NO: 1594 - DNA, 24 bp, Artificial Sequence
  Description of Artificial Sequence: Synthetic oligonucleotide
cagggactcctcgaggagtccctg

SEQ ID NO: 1595 - DNA, 24 bp, Artificial Sequence
  Description of Artificial Sequence: Synthetic oligonucleotide
ccaggactcctcgaggagtcctgg

SEQ ID NO: 1596 - DNA, 24 bp, Artificial Sequence
  Description of Artificial Sequence: Synthetic oligonucleotide
ccgagactcctcgaggagtctcgg

SEQ ID NO: 1597 - DNA, 24 bp, Artificial Sequence
  Description of Artificial Sequence: Synthetic oligonucleotide
tcgggactcctcgaggagtcccga

SEQ ID NO: 1598 - DNA, 24 bp, Artificial Sequence
  Description of Artificial Sequence: Synthetic oligonucleotide
ctgggactcctcgaggagtcccag

SEQ ID NO: 1599 - DNA, 24 bp, Artificial Sequence
  Description of Artificial Sequence: Synthetic oligonucleotide
cctggactcctcgaggagtccagg

SEQ ID NO: 1600 - DNA, 24 bp, Artificial Sequence
  Description of Artificial Sequence: Synthetic oligonucleotide
ccgtgactcctcgaggagtcacgg

SEQ ID NO: 1601 - DNA, 24 bp, Artificial Sequence
  Description of Artificial Sequence: Synthetic oligonucleotide
cggcgactcctcgaggagtcgccg

SEQ ID NO: 1602 - DNA, 24 bp, Artificial Sequence
  Description of Artificial Sequence: Synthetic oligonucleotide
cagcgactcctcgaggagtcgctg

SEQ ID NO: 1603 - DNA, 24 bp, Artificial Sequence
  Description of Artificial Sequence: Synthetic oligonucleotide
cgacgactcctcgaggagtcgtcg

SEQ ID NO: 1604 - DNA, 24 bp, Artificial Sequence
  Description of Artificial Sequence: Synthetic oligonucleotide
cggagactcctcgaggagtctccg

SEQ ID NO: 1605 - DNA, 24 bp, Artificial Sequence
  Description of Artificial Sequence: Synthetic oligonucleotide
ctgcgactcctcgaggagtcgcag

SEQ ID NO: 1606 - DNA, 24 bp, Artificial Sequence
  Description of Artificial Sequence: Synthetic oligonucleotide
cggtgactcctcgaggagtcaccg

SEQ ID NO: 1607 - DNA, 24 bp, Artificial Sequence
  Description of Artificial Sequence: Synthetic oligonucleotide
cacggactcctcgaggagtccgtg

SEQ ID NO: 1608 - DNA, 24 bp, Artificial Sequence
  Description of Artificial Sequence: Synthetic oligonucleotide
cccagactcctcgaggagtctggg

SEQ ID NO: 1609 - DNA, 24 bp, Artificial Sequence
  Description of Artificial Sequence: Synthetic oligonucleotide
ctcggactcctcgaggagtccgag

SEQ ID NO: 1610 - DNA, 24 bp, Artificial Sequence
  Description of Artificial Sequence: Synthetic oligonucleotide
ccctgactcctcgaggagtcaggg

SEQ ID NO: 1611 - DNA, 24 bp, Artificial Sequence
  Description of Artificial Sequence: Synthetic oligonucleotide
ccacgactcctcgaggagtcgtgg

SEQ ID NO: 1612 - DNA, 24 bp, Artificial Sequence
  Description of Artificial Sequence: Synthetic oligonucleotide
agccgactcctcgaggagtcggct

SEQ ID NO: 1613 - DNA, 24 bp, Artificial Sequence
  Description of Artificial Sequence: Synthetic oligonucleotide
tgccgactcctcgaggagtcggca

SEQ ID NO: 1614 - DNA, 24 bp, Artificial Sequence
  Description of Artificial Sequence: Synthetic oligonucleotide
gcgagactcctcgaggagtctcgc

SEQ ID NO: 1615 - DNA, 24 bp, Artificial Sequence
  Description of Artificial Sequence: Synthetic oligonucleotide
gcgtgactcctcgaggagtcacgc

SEQ ID NO: 1616 - DNA, 24 bp, Artificial Sequence
  Description of Artificial Sequence: Synthetic oligonucleotide
gcaggactcctcgaggagtcctgc

SEQ ID NO: 1617 - DNA, 24 bp, Artificial Sequence
  Description of Artificial Sequence: Synthetic oligonucleotide
gctggactcctcgaggagtccagc

SEQ ID NO: 1618 - DNA, 24 bp, Artificial Sequence
  Description of Artificial Sequence: Synthetic oligonucleotide
cgaggactcctcgaggagtcctcg

SEQ ID NO: 1619 - DNA, 24 bp, Artificial Sequence
  Description of Artificial Sequence: Synthetic oligonucleotide
cgtggactcctcgaggagtccacg

SEQ ID NO: 1620 - DNA, 24 bp, Artificial Sequence
  Description of Artificial Sequence: Synthetic oligonucleotide
caccgactcctcgaggagtcggtg

SEQ ID NO: 1621 - DNA, 24 bp, Artificial Sequence
  Description of Artificial Sequence: Synthetic oligonucleotide
ctccgactcctcgaggagtcggag

SEQ ID NO: 1622 - DNA, 24 bp, Artificial Sequence
  Description of Artificial Sequence: Synthetic oligonucleotide
gcgggactcctcgaggagtcccgc

SEQ ID NO: 1623 - DNA, 24 bp, Artificial Sequence
  Description of Artificial Sequence: Synthetic oligonucleotide
gagggactcctcgaggagtccctc

SEQ ID NO: 1624 - DNA, 24 bp, Artificial Sequence
  Description of Artificial Sequence: Synthetic oligonucleotide
gtgggactcctcgaggagtcccac

SEQ ID NO: 1625 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccaattggagtcnnnn

SEQ ID NO: 1626 - DNA, 24 bp, Artificial Sequence
  Description of Artificial Sequence: Synthetic oligonucleotide
ggcggactccaattggagtccgcc

SEQ ID NO: 1627 - DNA, 24 bp, Artificial Sequence
  Description of Artificial Sequence: Synthetic oligonucleotide
agcggactccaattggagtccgct

SEQ ID NO: 1628 - DNA, 24 bp, Artificial Sequence
  Description of Artificial Sequence: Synthetic oligonucleotide
gacggactccaattggagtccgtc

SEQ ID NO: 1629 - DNA, 24 bp, Artificial Sequence
  Description of Artificial Sequence: Synthetic oligonucleotide
ggaggactccaattggagtcctcc

SEQ ID NO: 1630 - DNA, 24 bp, Artificial Sequence
  Description of Artificial Sequence: Synthetic oligonucleotide
ggcagactccaattggagtctgcc

SEQ ID NO: 1631 - DNA, 24 bp, Artificial Sequence
  Description of Artificial Sequence: Synthetic oligonucleotide
tgcggactccaattggagtccgca

SEQ ID NO: 1632 - DNA, 24 bp, Artificial Sequence
  Description of Artificial Sequence: Synthetic oligonucleotide
gtcggactccaattggagtccgac

SEQ ID NO: 1633 - DNA, 24 bp, Artificial Sequence
  Description of Artificial Sequence: Synthetic oligonucleotide
ggtggactccaattggagtccacc

SEQ ID NO: 1634 - DNA, 24 bp, Artificial Sequence
  Description of Artificial Sequence: Synthetic oligonucleotide
ggctgactccaattggagtcagcc

SEQ ID NO: 1635 - DNA, 24 bp, Artificial Sequence
  Description of Artificial Sequence: Synthetic oligonucleotide
gcccgactccaattggagtcgggc

SEQ ID NO: 1636 - DNA, 24 bp, Artificial Sequence
  Description of Artificial Sequence: Synthetic oligonucleotide
acccgactccaattggagtcgggt

SEQ ID NO: 1637 - DNA, 24 bp, Artificial Sequence
  Description of Artificial Sequence: Synthetic oligonucleotide
gaccgactccaattggagtcggtc

SEQ ID NO: 1638 - DNA, 24 bp, Artificial Sequence
  Description of Artificial Sequence: Synthetic oligonucleotide
gcacgactccaattggagtcgtgc

SEQ ID NO: 1639 - DNA, 24 bp, Artificial Sequence
  Description of Artificial Sequence: Synthetic oligonucleotide
gccagactccaattggagtctggc

SEQ ID NO: 1640 - DNA, 24 bp, Artificial Sequence
  Description of Artificial Sequence: Synthetic oligonucleotide
tcccgactccaattggagtcggga

SEQ ID NO: 1641 - DNA, 24 bp, Artificial Sequence
  Description of Artificial Sequence: Synthetic oligonucleotide
gtccgactccaattggagtcggac

SEQ ID NO: 1642 - DNA, 24 bp, Artificial Sequence
  Description of Artificial Sequence: Synthetic oligonucleotide
gcctgactccaattggagtcaggc

SEQ ID NO: 1643 - DNA, 24 bp, Artificial Sequence
  Description of Artificial Sequence: Synthetic oligonucleotide
gggcgactccaattggagtcgccc

SEQ ID NO: 1644 - DNA, 24 bp, Artificial Sequence
  Description of Artificial Sequence: Synthetic oligonucleotide
aggcgactccaattggagtcgcct

SEQ ID NO: 1645 - DNA, 24 bp, Artificial Sequence
  Description of Artificial Sequence: Synthetic oligonucleotide
gagcgactccaattggagtcgctc

SEQ ID NO: 1646 - DNA, 24 bp, Artificial Sequence
  Description of Artificial Sequence: Synthetic oligonucleotide
ggacgactccaattggagtcgtcc

SEQ ID NO: 1647 - DNA, 24 bp, Artificial Sequence
  Description of Artificial Sequence: Synthetic oligonucleotide
gggagactccaattggagtctccc

SEQ ID NO: 1648 - DNA, 24 bp, Artificial Sequence
  Description of Artificial Sequence: Synthetic oligonucleotide
tggcgactccaattggagtcgcca

SEQ ID NO: 1649 - DNA, 24 bp, Artificial Sequence
  Description of Artificial Sequence: Synthetic oligonucleotide
gtgcgactccaattggagtcgcac

SEQ ID NO: 1650 - DNA, 24 bp, Artificial Sequence
  Description of Artificial Sequence: Synthetic oligonucleotide
gggtgactccaattggagtcaccc

SEQ ID NO: 1651 - DNA, 24 bp, Artificial Sequence
  Description of Artificial Sequence: Synthetic oligonucleotide
acgggactccaattggagtcccgt

SEQ ID NO: 1652 - DNA, 24 bp, Artificial Sequence
  Description of Artificial Sequence: Synthetic oligonucleotide
cagggactccaattggagtccctg

SEQ ID NO: 1653 - DNA, 24 bp, Artificial Sequence
  Description of Artificial Sequence: Synthetic oligonucleotide
ccaggactccaattggagtcctgg

SEQ ID NO: 1654 - DNA, 24 bp, Artificial Sequence
  Description of Artificial Sequence: Synthetic oligonucleotide
ccgagactccaattggagtctcgg

SEQ ID NO: 1655 - DNA, 24 bp, Artificial Sequence
  Description of Artificial Sequence: Synthetic oligonucleotide
tcgggactccaattggagtcccga

SEQ ID NO: 1656 - DNA, 24 bp, Artificial Sequence
  Description of Artificial Sequence: Synthetic oligonucleotide
ctgggactccaattggagtcccag

SEQ ID NO: 1657 - DNA, 24 bp, Artificial Sequence
  Description of Artificial Sequence: Synthetic oligonucleotide
cctggactccaattggagtccagg

SEQ ID NO: 1658 - DNA, 24 bp, Artificial Sequence
  Description of Artificial Sequence: Synthetic oligonucleotide
ccgtgactccaattggagtcacgg

SEQ ID NO: 1659 - DNA, 24 bp, Artificial Sequence
  Description of Artificial Sequence: Synthetic oligonucleotide
cggcgactccaattggagtcgccg

SEQ ID NO: 1660 - DNA, 24 bp, Artificial Sequence
  Description of Artificial Sequence: Synthetic oligonucleotide
cagcgactccaattggagtcgctg

SEQ ID NO: 1661 - DNA, 24 bp, Artificial Sequence
  Description of Artificial Sequence: Synthetic oligonucleotide
cgacgactccaattggagtcgtcg

SEQ ID NO: 1662 - DNA, 24 bp, Artificial Sequence
  Description of Artificial Sequence: Synthetic oligonucleotide
cggagactccaattggagtctccg

SEQ ID NO: 1663 - DNA, 24 bp, Artificial Sequence
  Description of Artificial Sequence: Synthetic oligonucleotide
ctgcgactccaattggagtcgcag

SEQ ID NO: 1664 - DNA, 24 bp, Artificial Sequence
  Description of Artificial Sequence: Synthetic oligonucleotide
cggtgactccaattggagtcaccg

SEQ ID NO: 1665 - DNA, 24 bp, Artificial Sequence
  Description of Artificial Sequence: Synthetic oligonucleotide
cacggactccaattggagtccgtg

SEQ ID NO: 1666 - DNA, 24 bp, Artificial Sequence
  Description of Artificial Sequence: Synthetic oligonucleotide
cccagactccaattggagtctggg

SEQ ID NO: 1667 - DNA, 24 bp, Artificial Sequence
  Description of Artificial Sequence: Synthetic oligonucleotide
ctcggactccaattggagtccgag

SEQ ID NO: 1668 - DNA, 24 bp, Artificial Sequence
  Description of Artificial Sequence: Synthetic oligonucleotide
ccctgactccaattggagtcaggg

SEQ ID NO: 1669 - DNA, 24 bp, Artificial Sequence
  Description of Artificial Sequence: Synthetic oligonucleotide
ccacgactccaattggagtcgtgg

SEQ ID NO: 1670 - DNA, 24 bp, Artificial Sequence
  Description of Artificial Sequence: Synthetic oligonucleotide
agccgactccaattggagtcggct

SEQ ID NO: 1671 - DNA, 24 bp, Artificial Sequence
  Description of Artificial Sequence: Synthetic oligonucleotide
tgccgactccaattggagtcggca

SEQ ID NO: 1672 - DNA, 24 bp, Artificial Sequence
  Description of Artificial Sequence: Synthetic oligonucleotide
gcgagactccaattggagtctcgc

SEQ ID NO: 1673 - DNA, 24 bp, Artificial Sequence
  Description of Artificial Sequence: Synthetic oligonucleotide
gcgtgactccaattggagtcacgc

SEQ ID NO: 1674 - DNA, 24 bp, Artificial Sequence
  Description of Artificial Sequence: Synthetic oligonucleotide
gcaggactccaattggagtcctgc

SEQ ID NO: 1675 - DNA, 24 bp, Artificial Sequence
  Description of Artificial Sequence: Synthetic oligonucleotide
gctggactccaattggagtccagc

SEQ ID NO: 1676 - DNA, 24 bp, Artificial Sequence
  Description of Artificial Sequence: Synthetic oligonucleotide
cgaggactccaattggagtcctcg

SEQ ID NO: 1677 - DNA, 24 bp, Artificial Sequence
  Description of Artificial Sequence: Synthetic oligonucleotide
cgtggactccaattggagtccacg

SEQ ID NO: 1678 - DNA, 24 bp, Artificial Sequence
  Description of Artificial Sequence: Synthetic oligonucleotide
caccgactccaattggagtcggtg

SEQ ID NO: 1679 - DNA, 24 bp, Artificial Sequence
  Description of Artificial Sequence: Synthetic oligonucleotide
ctccgactccaattggagtcggag

SEQ ID NO: 1680 - DNA, 24 bp, Artificial Sequence
  Description of Artificial Sequence: Synthetic oligonucleotide
gcgggactccaattggagtcccgc

SEQ ID NO: 1681 - DNA, 24 bp, Artificial Sequence
  Description of Artificial Sequence: Synthetic oligonucleotide
gagggactccaattggagtccctc

SEQ ID NO: 1682 - DNA, 24 bp, Artificial Sequence
  Description of Artificial Sequence: Synthetic oligonucleotide
gtgggactccaattggagtcccac

SEQ ID NO: 1683 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccatatggagtcnnnn

SEQ ID NO: 1684 - DNA, 24 bp, Artificial Sequence
  Description of Artificial Sequence: Synthetic oligonucleotide
ggcggactccatatggagtccgcc

SEQ ID NO: 1685 - DNA, 24 bp, Artificial Sequence
  Description of Artificial Sequence: Synthetic oligonucleotide
agcggactccatatggagtccgct

SEQ ID NO: 1686 - DNA, 24 bp, Artificial Sequence
  Description of Artificial Sequence: Synthetic oligonucleotide
gacggactccatatggagtccgtc

SEQ ID NO: 1687 - DNA, 24 bp, Artificial Sequence
  Description of Artificial Sequence: Synthetic oligonucleotide
ggaggactccatatggagtcctcc

SEQ ID NO: 1688 - DNA, 24 bp, Artificial Sequence
  Description of Artificial Sequence: Synthetic oligonucleotide
ggcagactccatatggagtctgcc

SEQ ID NO: 1689 - DNA, 24 bp, Artificial Sequence
  Description of Artificial Sequence: Synthetic oligonucleotide
tgcggactccatatggagtccgca

SEQ ID NO: 1690 - DNA, 24 bp, Artificial Sequence
  Description of Artificial Sequence: Synthetic oligonucleotide
gtcggactccatatggagtccgac

SEQ ID NO: 1691 - DNA, 24 bp, Artificial Sequence
  Description of Artificial Sequence: Synthetic oligonucleotide
ggtggactccatatggagtccacc

SEQ ID NO: 1692 - DNA, 24 bp, Artificial Sequence
  Description of Artificial Sequence: Synthetic oligonucleotide
ggctgactccatatggagtcagcc

SEQ ID NO: 1693 - DNA, 24 bp, Artificial Sequence
  Description of Artificial Sequence: Synthetic oligonucleotide
gcccgactccatatggagtcgggc

SEQ ID NO: 1694 - DNA, 24 bp, Artificial Sequence
  Description of Artificial Sequence: Synthetic oligonucleotide
acccgactccatatggagtcgggt

SEQ ID NO: 1695 - DNA, 24 bp, Artificial Sequence
  Description of Artificial Sequence: Synthetic oligonucleotide
gaccgactccatatggagtcggtc

SEQ ID NO: 1696 - DNA, 24 bp, Artificial Sequence
  Description of Artificial Sequence: Synthetic oligonucleotide
gcacgactccatatggagtcgtgc

SEQ ID NO: 1697 - DNA, 24 bp, Artificial Sequence
  Description of Artificial Sequence: Synthetic oligonucleotide
gccagactccatatggagtctggc

SEQ ID NO: 1698 - DNA, 24 bp, Artificial Sequence
  Description of Artificial Sequence: Synthetic oligonucleotide
tcccgactccatatggagtcggga

SEQ ID NO: 1699 - DNA, 24 bp, Artificial Sequence
  Description of Artificial Sequence: Synthetic oligonucleotide
gtccgactccatatggagtcggac

SEQ ID NO: 1700 - DNA, 24 bp, Artificial Sequence
  Description of Artificial Sequence: Synthetic oligonucleotide
gcctgactccatatggagtcaggc

SEQ ID NO: 1701 - DNA, 24 bp, Artificial Sequence
  Description of Artificial Sequence: Synthetic oligonucleotide
gggcgactccatatggagtcgccc

SEQ ID NO: 1702 - DNA, 24 bp, Artificial Sequence
  Description of Artificial Sequence: Synthetic oligonucleotide
aggcgactccatatggagtcgcct

SEQ ID NO: 1703 - DNA, 24 bp, Artificial Sequence
  Description of Artificial Sequence: Synthetic oligonucleotide
gagcgactccatatggagtcgctc

SEQ ID NO: 1704 - DNA, 24 bp, Artificial Sequence
  Description of Artificial Sequence: Synthetic oligonucleotide
ggacgactccatatggagtcgtcc

SEQ ID NO: 1705 - DNA, 24 bp, Artificial Sequence
  Description of Artificial Sequence: Synthetic oligonucleotide
gggagactccatatggagtctccc

SEQ ID NO: 1706 - DNA, 24 bp, Artificial Sequence
  Description of Artificial Sequence: Synthetic oligonucleotide
tggcgactccatatggagtcgcca

SEQ ID NO: 1707 - DNA, 24 bp, Artificial Sequence
  Description of Artificial Sequence: Synthetic oligonucleotide
gtgcgactccatatggagtcgcac

SEQ ID NO: 1708 - DNA, 24 bp, Artificial Sequence
  Description of Artificial Sequence: Synthetic oligonucleotide
gggtgactccatatggagtcaccc

SEQ ID NO: 1709 - DNA, 24 bp, Artificial Sequence
  Description of Artificial Sequence: Synthetic oligonucleotide
acgggactccatatggagtcccgt

SEQ ID NO: 1710 - DNA, 24 bp, Artificial Sequence
  Description of Artificial Sequence: Synthetic oligonucleotide
cagggactccatatggagtccctg

SEQ ID NO: 1711 - DNA, 24 bp, Artificial Sequence
  Description of Artificial Sequence: Synthetic oligonucleotide
ccaggactccatatggagtcctgg

SEQ ID NO: 1712 - DNA, 24 bp, Artificial Sequence
  Description of Artificial Sequence: Synthetic oligonucleotide
ccgagactccatatggagtctcgg

SEQ ID NO: 1713 - DNA, 24 bp, Artificial Sequence
  Description of Artificial Sequence: Synthetic oligonucleotide
tcgggactccatatggagtcccga

SEQ ID NO: 1714 - DNA, 24 bp, Artificial Sequence
  Description of Artificial Sequence: Synthetic oligonucleotide
ctgggactccatatggagtcccag

SEQ ID NO: 1715 - DNA, 24 bp, Artificial Sequence
  Description of Artificial Sequence: Synthetic oligonucleotide
cctggactccatatggagtccagg

SEQ ID NO: 1716 - DNA, 24 bp, Artificial Sequence
  Description of Artificial Sequence: Synthetic oligonucleotide
ccgtgactccatatggagtcacgg

SEQ ID NO: 1717 - DNA, 24 bp, Artificial Sequence
  Description of Artificial Sequence: Synthetic oligonucleotide
cggcgactccatatggagtcgccg

SEQ ID NO: 1718 - DNA, 24 bp, Artificial Sequence
  Description of Artificial Sequence: Synthetic oligonucleotide
cagcgactccatatggagtcgctg

SEQ ID NO: 1719 - DNA, 24 bp, Artificial Sequence
  Description of Artificial Sequence: Synthetic oligonucleotide
cgacgactccatatggagtcgtcg

SEQ ID NO: 1720 - DNA, 24 bp, Artificial Sequence
  Description of Artificial Sequence: Synthetic oligonucleotide
cggagactccatatggagtctccg

SEQ ID NO: 1721 - DNA, 24 bp, Artificial Sequence
  Description of Artificial Sequence: Synthetic oligonucleotide
ctgcgactccatatggagtcgcag

SEQ ID NO: 1722 - DNA, 24 bp, Artificial Sequence
  Description of Artificial Sequence: Synthetic oligonucleotide
cggtgactccatatggagtcaccg

SEQ ID NO: 1723 - DNA, 24 bp, Artificial Sequence
  Description of Artificial Sequence: Synthetic oligonucleotide
cacggactccatatggagtccgtg

SEQ ID NO: 1724 - DNA, 24 bp, Artificial Sequence
  Description of Artificial Sequence: Synthetic oligonucleotide
cccagactccatatggagtctggg

SEQ ID NO: 1725 - DNA, 24 bp, Artificial Sequence
  Description of Artificial Sequence: Synthetic oligonucleotide
ctcggactccatatggagtccgag

SEQ ID NO: 1726 - DNA, 24 bp, Artificial Sequence
  Description of Artificial Sequence: Synthetic oligonucleotide
ccctgactccatatggagtcaggg

SEQ ID NO: 1727 - DNA, 24 bp, Artificial Sequence
  Description of Artificial Sequence: Synthetic oligonucleotide
ccacgactccatatggagtcgtgg

SEQ ID NO: 1728 - DNA, 24 bp, Artificial Sequence
  Description of Artificial Sequence: Synthetic oligonucleotide
agccgactccatatggagtcggct

SEQ ID NO: 1729 - DNA, 24 bp, Artificial Sequence
  Description of Artificial Sequence: Synthetic oligonucleotide
tgccgactccatatggagtcggca

SEQ ID NO: 1730 - DNA, 24 bp, Artificial Sequence
  Description of Artificial Sequence: Synthetic oligonucleotide
gcgagactccatatggagtctcgc

SEQ ID NO: 1731 - DNA, 24 bp, Artificial Sequence
  Description of Artificial Sequence: Synthetic oligonucleotide
gcgtgactccatatggagtcacgc

SEQ ID NO: 1732 - DNA, 24 bp, Artificial Sequence
  Description of Artificial Sequence: Synthetic oligonucleotide
gcaggactccatatggagtcctgc

SEQ ID NO: 1733 - DNA, 24 bp, Artificial Sequence
  Description of Artificial Sequence: Synthetic oligonucleotide
gctggactccatatggagtccagc

SEQ ID NO: 1734 - DNA, 24 bp, Artificial Sequence
  Description of Artificial Sequence: Synthetic oligonucleotide
cgaggactccatatggagtcctcg

SEQ ID NO: 1735 - DNA, 24 bp, Artificial Sequence
  Description of Artificial Sequence: Synthetic oligonucleotide
cgtggactccatatggagtccacg

SEQ ID NO: 1736 - DNA, 24 bp, Artificial Sequence
  Description of Artificial Sequence: Synthetic oligonucleotide
caccgactccatatggagtcggtg

SEQ ID NO: 1737 - DNA, 24 bp, Artificial Sequence
  Description of Artificial Sequence: Synthetic oligonucleotide
ctccgactccatatggagtcggag

SEQ ID NO: 1738 - DNA, 24 bp, Artificial Sequence
  Description of Artificial Sequence: Synthetic oligonucleotide
gcgggactccatatggagtcccgc

SEQ ID NO: 1739 - DNA, 24 bp, Artificial Sequence
  Description of Artificial Sequence: Synthetic oligonucleotide
gagggactccatatggagtccctc

SEQ ID NO: 1740 - DNA, 24 bp, Artificial Sequence
  Description of Artificial Sequence: Synthetic oligonucleotide
gtgggactccatatggagtcccac

SEQ ID NO: 1741 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccagctggagtcnnnn

SEQ ID NO: 1742 - DNA, 24 bp, Artificial Sequence
  Description of Artificial Sequence: Synthetic oligonucleotide
ggcggactccagctggagtccgcc

SEQ ID NO: 1743 - DNA, 24 bp, Artificial Sequence
  Description of Artificial Sequence: Synthetic oligonucleotide
agcggactccagctggagtccgct

SEQ ID NO: 1744 - DNA, 24 bp, Artificial Sequence
  Description of Artificial Sequence: Synthetic oligonucleotide
gacggactccagctggagtccgtc

SEQ ID NO: 1745 - DNA, 24 bp, Artificial Sequence
  Description of Artificial Sequence: Synthetic oligonucleotide
ggaggactccagctggagtcctcc

SEQ ID NO: 1746 - DNA, 24 bp, Artificial Sequence
  Description of Artificial Sequence: Synthetic oligonucleotide
ggcagactccagctggagtctgcc

SEQ ID NO: 1747 - DNA, 24 bp, Artificial Sequence
  Description of Artificial Sequence: Synthetic oligonucleotide
tgcggactccagctggagtccgca

SEQ ID NO: 1748 - DNA, 24 bp, Artificial Sequence
  Description of Artificial Sequence: Synthetic oligonucleotide
gtcggactccagctggagtccgac

SEQ ID NO: 1749 - DNA, 24 bp, Artificial Sequence
  Description of Artificial Sequence: Synthetic oligonucleotide
ggtggactccagctggagtccacc

SEQ ID NO: 1750 - DNA, 24 bp, Artificial Sequence
  Description of Artificial Sequence: Synthetic oligonucleotide
ggctgactccagctggagtcagcc

SEQ ID NO: 1751 - DNA, 24 bp, Artificial Sequence
  Description of Artificial Sequence: Synthetic oligonucleotide
gcccgactccagctggagtcgggc

SEQ ID NO: 1752 - DNA, 24 bp, Artificial Sequence
  Description of Artificial Sequence: Synthetic oligonucleotide
acccgactccagctggagtcgggt

SEQ ID NO: 1753 - DNA, 24 bp, Artificial Sequence
  Description of Artificial Sequence: Synthetic oligonucleotide
gaccgactccagctggagtcggtc

SEQ ID NO: 1754 - DNA, 24 bp, Artificial Sequence
  Description of Artificial Sequence: Synthetic oligonucleotide
gcacgactccagctggagtcgtgc

SEQ ID NO: 1755 - DNA, 24 bp, Artificial Sequence
  Description of Artificial Sequence: Synthetic oligonucleotide
gccagactccagctggagtctggc

SEQ ID NO: 1756 - DNA, 24 bp, Artificial Sequence
  Description of Artificial Sequence: Synthetic oligonucleotide
tcccgactccagctggagtcggga

SEQ ID NO: 1757 - DNA, 24 bp, Artificial Sequence
  Description of Artificial Sequence: Synthetic oligonucleotide
gtccgactccagctggagtcggac

SEQ ID NO: 1758 - DNA, 24 bp, Artificial Sequence
  Description of Artificial Sequence: Synthetic oligonucleotide
gcctgactccagctggagtcaggc

SEQ ID NO: 1759 - DNA, 24 bp, Artificial Sequence
  Description of Artificial Sequence: Synthetic oligonucleotide
gggcgactccagctggagtcgccc

SEQ ID NO: 1760 - DNA, 24 bp, Artificial Sequence
  Description of Artificial Sequence: Synthetic oligonucleotide
aggcgactccagctggagtcgcct

SEQ ID NO: 1761 - DNA, 24 bp, Artificial Sequence
  Description of Artificial Sequence: Synthetic oligonucleotide
gagcgactccagctggagtcgctc

SEQ ID NO: 1762 - DNA, 24 bp, Artificial Sequence
  Description of Artificial Sequence: Synthetic oligonucleotide
ggacgactccagctggagtcgtcc

SEQ ID NO: 1763 - DNA, 24 bp, Artificial Sequence
  Description of Artificial Sequence: Synthetic oligonucleotide
gggagactccagctggagtctccc

SEQ ID NO: 1764 - DNA, 24 bp, Artificial Sequence
  Description of Artificial Sequence: Synthetic oligonucleotide
tggcgactccagctggagtcgcca

SEQ ID NO: 1765 - DNA, 24 bp, Artificial Sequence
  Description of Artificial Sequence: Synthetic oligonucleotide
gtgcgactccagctggagtcgcac

SEQ ID NO: 1766 - DNA, 24 bp, Artificial Sequence
  Description of Artificial Sequence: Synthetic oligonucleotide
gggtgactccagctggagtcaccc

SEQ ID NO: 1767 - DNA, 24 bp, Artificial Sequence
  Description of Artificial Sequence: Synthetic oligonucleotide
acgggactccagctggagtcccgt

SEQ ID NO: 1768 - DNA, 24 bp, Artificial Sequence
  Description of Artificial Sequence: Synthetic oligonucleotide
cagggactccagctggagtccctg

SEQ ID NO: 1769 - DNA, 24 bp, Artificial Sequence
  Description of Artificial Sequence: Synthetic oligonucleotide
ccaggactccagctggagtcctgg

SEQ ID NO: 1770 - DNA, 24 bp, Artificial Sequence
  Description of Artificial Sequence: Synthetic oligonucleotide
ccgagactccagctggagtctcgg

SEQ ID NO: 1771 - DNA, 24 bp, Artificial Sequence
  Description of Artificial Sequence: Synthetic oligonucleotide
tcgggactccagctggagtcccga

SEQ ID NO: 1772 - DNA, 24 bp, Artificial Sequence
  Description of Artificial Sequence: Synthetic oligonucleotide
ctgggactccagctggagtcccag

SEQ ID NO: 1773 - DNA, 24 bp, Artificial Sequence
  Description of Artificial Sequence: Synthetic oligonucleotide
cctggactccagctggagtccagg

SEQ ID NO: 1774 - DNA, 24 bp, Artificial Sequence
  Description of Artificial Sequence: Synthetic oligonucleotide
ccgtgactccagctggagtcacgg

SEQ ID NO: 1775 - DNA, 24 bp, Artificial Sequence
  Description of Artificial Sequence: Synthetic oligonucleotide
cggcgactccagctggagtcgccg

SEQ ID NO: 1776 - DNA, 24 bp, Artificial Sequence
  Description of Artificial Sequence: Synthetic oligonucleotide
cagcgactccagctggagtcgctg

SEQ ID NO: 1777 - DNA, 24 bp, Artificial Sequence
  Description of Artificial Sequence: Synthetic oligonucleotide
cgacgactccagctggagtcgtcg

SEQ ID NO: 1778 - DNA, 24 bp, Artificial Sequence
  Description of Artificial Sequence: Synthetic oligonucleotide
cggagactccagctggagtctccg

SEQ ID NO: 1779 - DNA, 24 bp, Artificial Sequence
  Description of Artificial Sequence: Synthetic oligonucleotide
ctgcgactccagctggagtcgcag

SEQ ID NO: 1780 - DNA, 24 bp, Artificial Sequence
  Description of Artificial Sequence: Synthetic oligonucleotide
cggtgactccagctggagtcaccg

SEQ ID NO: 1781 - DNA, 24 bp, Artificial Sequence
  Description of Artificial Sequence: Synthetic oligonucleotide
cacggactccagctggagtccgtg

SEQ ID NO: 1782 - DNA, 24 bp, Artificial Sequence
  Description of Artificial Sequence: Synthetic oligonucleotide
cccagactccagctggagtctggg

SEQ ID NO: 1783 - DNA, 24 bp, Artificial Sequence
  Description of Artificial Sequence: Synthetic oligonucleotide
ctcggactccagctggagtccgag

SEQ ID NO: 1784 - DNA, 24 bp, Artificial Sequence
  Description of Artificial Sequence: Synthetic oligonucleotide
ccctgactccagctggagtcaggg

SEQ ID NO: 1785 - DNA, 24 bp, Artificial Sequence
  Description of Artificial Sequence: Synthetic oligonucleotide
ccacgactccagctggagtcgtgg

SEQ ID NO: 1786 - DNA, 24 bp, Artificial Sequence
  Description of Artificial Sequence: Synthetic oligonucleotide
agccgactccagctggagtcggct

SEQ ID NO: 1787 - DNA, 24 bp, Artificial Sequence
  Description of Artificial Sequence: Synthetic oligonucleotide
tgccgactccagctggagtcggca

SEQ ID NO: 1788 - DNA, 24 bp, Artificial Sequence
  Description of Artificial Sequence: Synthetic oligonucleotide
gcgagactccagctggagtctcgc

SEQ ID NO: 1789 - DNA, 24 bp, Artificial Sequence
  Description of Artificial Sequence: Synthetic oligonucleotide
gcgtgactccagctggagtcacgc

SEQ ID NO: 1790 - DNA, 24 bp, Artificial Sequence
  Description of Artificial Sequence: Synthetic oligonucleotide
gcaggactccagctggagtcctgc

SEQ ID NO: 1791 - DNA, 24 bp, Artificial Sequence
  Description of Artificial Sequence: Synthetic oligonucleotide
gctggactccagctggagtccagc

SEQ ID NO: 1792 - DNA, 24 bp, Artificial Sequence
  Description of Artificial Sequence: Synthetic oligonucleotide
cgaggactccagctggagtcctcg

SEQ ID NO: 1793 - DNA, 24 bp, Artificial Sequence
  Description of Artificial Sequence: Synthetic oligonucleotide
cgtggactccagctggagtccacg

SEQ ID NO: 1794 - DNA, 24 bp, Artificial Sequence
  Description of Artificial Sequence: Synthetic oligonucleotide
caccgactccagctggagtcggtg

SEQ ID NO: 1795 - DNA, 24 bp, Artificial Sequence
  Description of Artificial Sequence: Synthetic oligonucleotide
ctccgactccagctggagtcggag

SEQ ID NO: 1796 - DNA, 24 bp, Artificial Sequence
  Description of Artificial Sequence: Synthetic oligonucleotide
gcgggactccagctggagtcccgc

SEQ ID NO: 1797 - DNA, 24 bp, Artificial Sequence
  Description of Artificial Sequence: Synthetic oligonucleotide
gagggactccagctggagtccctc

SEQ ID NO: 1798 - DNA, 24 bp, Artificial Sequence
  Description of Artificial Sequence: Synthetic oligonucleotide
gtgggactccagctggagtcccac

SEQ ID NO: 1799 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactccacgtggagtcnnnn

SEQ ID NO: 1800 - DNA, 24 bp, Artificial Sequence
  Description of Artificial Sequence: Synthetic oligonucleotide
ggcggactccacgtggagtccgcc

SEQ ID NO: 1801 - DNA, 24 bp, Artificial Sequence
  Description of Artificial Sequence: Synthetic oligonucleotide
agcggactccacgtggagtccgct

SEQ ID NO: 1802 - DNA, 24 bp, Artificial Sequence
  Description of Artificial Sequence: Synthetic oligonucleotide
gacggactccacgtggagtccgtc

SEQ ID NO: 1803 - DNA, 24 bp, Artificial Sequence
  Description of Artificial Sequence: Synthetic oligonucleotide
ggaggactccacgtggagtcctcc

SEQ ID NO: 1804 - DNA, 24 bp, Artificial Sequence
  Description of Artificial Sequence: Synthetic oligonucleotide
ggcagactccacgtggagtctgcc

SEQ ID NO: 1805 - DNA, 24 bp, Artificial Sequence
  Description of Artificial Sequence: Synthetic oligonucleotide
tgcggactccacgtggagtccgca

SEQ ID NO: 1806 - DNA, 24 bp, Artificial Sequence
  Description of Artificial Sequence: Synthetic oligonucleotide
gtcggactccacgtggagtccgac

SEQ ID NO: 1807 - DNA, 24 bp, Artificial Sequence
  Description of Artificial Sequence: Synthetic oligonucleotide
ggtggactccacgtggagtccacc

SEQ ID NO: 1808 - DNA, 24 bp, Artificial Sequence
  Description of Artificial Sequence: Synthetic oligonucleotide
ggctgactccacgtggagtcagcc

SEQ ID NO: 1809 - DNA, 24 bp, Artificial Sequence
  Description of Artificial Sequence: Synthetic oligonucleotide
gcccgactccacgtggagtcgggc

SEQ ID NO: 1810 - DNA, 24 bp, Artificial Sequence
  Description of Artificial Sequence: Synthetic oligonucleotide
acccgactccacgtggagtcgggt

SEQ ID NO: 1811 - DNA, 24 bp, Artificial Sequence
  Description of Artificial Sequence: Synthetic oligonucleotide
gaccgactccacgtggagtcggtc

SEQ ID NO: 1812 - DNA, 24 bp, Artificial Sequence
  Description of Artificial Sequence: Synthetic oligonucleotide
gcacgactccacgtggagtcgtgc

SEQ ID NO: 1813 - DNA, 24 bp, Artificial Sequence
  Description of Artificial Sequence: Synthetic oligonucleotide
gccagactccacgtggagtctggc

SEQ ID NO: 1814 - DNA, 24 bp, Artificial Sequence
  Description of Artificial Sequence: Synthetic oligonucleotide
tcccgactccacgtggagtcggga

SEQ ID NO: 1815 - DNA, 24 bp, Artificial Sequence
  Description of Artificial Sequence: Synthetic oligonucleotide
gtccgactccacgtggagtcggac

SEQ ID NO: 1816 - DNA, 24 bp, Artificial Sequence
  Description of Artificial Sequence: Synthetic oligonucleotide
gcctgactccacgtggagtcaggc

SEQ ID NO: 1817 - DNA, 24 bp, Artificial Sequence
  Description of Artificial Sequence: Synthetic oligonucleotide
gggcgactccacgtggagtcgccc

SEQ ID NO: 1818 - DNA, 24 bp, Artificial Sequence
  Description of Artificial Sequence: Synthetic oligonucleotide
aggcgactccacgtggagtcgcct

SEQ ID NO: 1819 - DNA, 24 bp, Artificial Sequence
  Description of Artificial Sequence: Synthetic oligonucleotide
gagcgactccacgtggagtcgctc

SEQ ID NO: 1820 - DNA, 24 bp, Artificial Sequence
  Description of Artificial Sequence: Synthetic oligonucleotide
ggacgactccacgtggagtcgtcc

SEQ ID NO: 1821 - DNA, 24 bp, Artificial Sequence
  Description of Artificial Sequence: Synthetic oligonucleotide
gggagactccacgtggagtctccc

SEQ ID NO: 1822 - DNA, 24 bp, Artificial Sequence
  Description of Artificial Sequence: Synthetic oligonucleotide
tggcgactccacgtggagtcgcca

SEQ ID NO: 1823 - DNA, 24 bp, Artificial Sequence
  Description of Artificial Sequence: Synthetic oligonucleotide
gtgcgactccacgtggagtcgcac

SEQ ID NO: 1824 - DNA, 24 bp, Artificial Sequence
  Description of Artificial Sequence: Synthetic oligonucleotide
gggtgactccacgtggagtcaccc

SEQ ID NO: 1825 - DNA, 24 bp, Artificial Sequence
  Description of Artificial Sequence: Synthetic oligonucleotide
acgggactccacgtggagtcccgt

SEQ ID NO: 1826 - DNA, 24 bp, Artificial Sequence
  Description of Artificial Sequence: Synthetic oligonucleotide
cagggactccacgtggagtccctg

SEQ ID NO: 1827 - DNA, 24 bp, Artificial Sequence
  Description of Artificial Sequence: Synthetic oligonucleotide
ccaggactccacgtggagtcctgg

SEQ ID NO: 1828 - DNA, 24 bp, Artificial Sequence
  Description of Artificial Sequence: Synthetic oligonucleotide
ccgagactccacgtggagtctcgg

SEQ ID NO: 1829 - DNA, 24 bp, Artificial Sequence
  Description of Artificial Sequence: Synthetic oligonucleotide
tcgggactccacgtggagtcccga

SEQ ID NO: 1830 - DNA, 24 bp, Artificial Sequence
  Description of Artificial Sequence: Synthetic oligonucleotide
ctgggactccacgtggagtcccag

SEQ ID NO: 1831 - DNA, 24 bp, Artificial Sequence
  Description of Artificial Sequence: Synthetic oligonucleotide
cctggactccacgtggagtccagg

SEQ ID NO: 1832 - DNA, 24 bp, Artificial Sequence
  Description of Artificial Sequence: Synthetic oligonucleotide
ccgtgactccacgtggagtcacgg

SEQ ID NO: 1833 - DNA, 24 bp, Artificial Sequence
  Description of Artificial Sequence: Synthetic oligonucleotide
cggcgactccacgtggagtcgccg

SEQ ID NO: 1834 - DNA, 24 bp, Artificial Sequence
  Description of Artificial Sequence: Synthetic oligonucleotide
cagcgactccacgtggagtcgctg

SEQ ID NO: 1835 - DNA, 24 bp, Artificial Sequence
  Description of Artificial Sequence: Synthetic oligonucleotide
cgacgactccacgtggagtcgtcg

SEQ ID NO: 1836 - DNA, 24 bp, Artificial Sequence
  Description of Artificial Sequence: Synthetic oligonucleotide
cggagactccacgtggagtctccg

SEQ ID NO: 1837 - DNA, 24 bp, Artificial Sequence
  Description of Artificial Sequence: Synthetic oligonucleotide
ctgcgactccacgtggagtcgcag

SEQ ID NO: 1838 - DNA, 24 bp, Artificial Sequence
  Description of Artificial Sequence: Synthetic oligonucleotide
cggtgactccacgtggagtcaccg

SEQ ID NO: 1839 - DNA, 24 bp, Artificial Sequence
  Description of Artificial Sequence: Synthetic oligonucleotide
cacggactccacgtggagtccgtg

SEQ ID NO: 1840 - DNA, 24 bp, Artificial Sequence
  Description of Artificial Sequence: Synthetic oligonucleotide
cccagactccacgtggagtctggg

SEQ ID NO: 1841 - DNA, 24 bp, Artificial Sequence
  Description of Artificial Sequence: Synthetic oligonucleotide
ctcggactccacgtggagtccgag

SEQ ID NO: 1842 - DNA, 24 bp, Artificial Sequence
  Description of Artificial Sequence: Synthetic oligonucleotide
ccctgactccacgtggagtcaggg

SEQ ID NO: 1843 - DNA, 24 bp, Artificial Sequence
  Description of Artificial Sequence: Synthetic oligonucleotide
ccacgactccacgtggagtcgtgg

SEQ ID NO: 1844 - DNA, 24 bp, Artificial Sequence
  Description of Artificial Sequence: Synthetic oligonucleotide
agccgactccacgtggagtcggct

SEQ ID NO: 1845 - DNA, 24 bp, Artificial Sequence
  Description of Artificial Sequence: Synthetic oligonucleotide
tgccgactccacgtggagtcggca

SEQ ID NO: 1846 - DNA, 24 bp, Artificial Sequence
  Description of Artificial Sequence: Synthetic oligonucleotide
gcgagactccacgtggagtctcgc

SEQ ID NO: 1847 - DNA, 24 bp, Artificial Sequence
  Description of Artificial Sequence: Synthetic oligonucleotide
gcgtgactccacgtggagtcacgc

SEQ ID NO: 1848 - DNA, 24 bp, Artificial Sequence
  Description of Artificial Sequence: Synthetic oligonucleotide
gcaggactccacgtggagtcctgc

SEQ ID NO: 1849 - DNA, 24 bp, Artificial Sequence
  Description of Artificial Sequence: Synthetic oligonucleotide
gctggactccacgtggagtccagc

SEQ ID NO: 1850 - DNA, 24 bp, Artificial Sequence
  Description of Artificial Sequence: Synthetic oligonucleotide
cgaggactccacgtggagtcctcg

SEQ ID NO: 1851 - DNA, 24 bp, Artificial Sequence
  Description of Artificial Sequence: Synthetic oligonucleotide
cgtggactccacgtggagtccacg

SEQ ID NO: 1852 - DNA, 24 bp, Artificial Sequence
  Description of Artificial Sequence: Synthetic oligonucleotide
caccgactccacgtggagtcggtg

SEQ ID NO: 1853 - DNA, 24 bp, Artificial Sequence
  Description of Artificial Sequence: Synthetic oligonucleotide
ctccgactccacgtggagtcggag

SEQ ID NO: 1854 - DNA, 24 bp, Artificial Sequence
  Description of Artificial Sequence: Synthetic oligonucleotide
gcgggactccacgtggagtcccgc

SEQ ID NO: 1855 - DNA, 24 bp, Artificial Sequence
  Description of Artificial Sequence: Synthetic oligonucleotide
gagggactccacgtggagtccctc

SEQ ID NO: 1856 - DNA, 24 bp, Artificial Sequence
  Description of Artificial Sequence: Synthetic oligonucleotide
gtgggactccacgtggagtcccac

SEQ ID NO: 1857 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctcatgagagtcnnnn

SEQ ID NO: 1858 - DNA, 24 bp, Artificial Sequence
  Description of Artificial Sequence: Synthetic oligonucleotide
ggcggactctcatgagagtccgcc

SEQ ID NO: 1859 - DNA, 24 bp, Artificial Sequence
  Description of Artificial Sequence: Synthetic oligonucleotide
agcggactctcatgagagtccgct

SEQ ID NO: 1860 - DNA, 24 bp, Artificial Sequence
  Description of Artificial Sequence: Synthetic oligonucleotide
gacggactctcatgagagtccgtc

SEQ ID NO: 1861 - DNA, 24 bp, Artificial Sequence
  Description of Artificial Sequence: Synthetic oligonucleotide
ggaggactctcatgagagtcctcc

SEQ ID NO: 1862 - DNA, 24 bp, Artificial Sequence
  Description of Artificial Sequence: Synthetic oligonucleotide
ggcagactctcatgagagtctgcc

SEQ ID NO: 1863 - DNA, 24 bp, Artificial Sequence
  Description of Artificial Sequence: Synthetic oligonucleotide
tgcggactctcatgagagtccgca

SEQ ID NO: 1864 - DNA, 24 bp, Artificial Sequence
  Description of Artificial Sequence: Synthetic oligonucleotide
gtcggactctcatgagagtccgac

SEQ ID NO: 1865 - DNA, 24 bp, Artificial Sequence
  Description of Artificial Sequence: Synthetic oligonucleotide
ggtggactctcatgagagtccacc

SEQ ID NO: 1866 - DNA, 24 bp, Artificial Sequence
  Description of Artificial Sequence: Synthetic oligonucleotide
ggctgactctcatgagagtcagcc

SEQ ID NO: 1867 - DNA, 24 bp, Artificial Sequence
  Description of Artificial Sequence: Synthetic oligonucleotide
gcccgactctcatgagagtcgggc

SEQ ID NO: 1868 - DNA, 24 bp, Artificial Sequence
  Description of Artificial Sequence: Synthetic oligonucleotide
acccgactctcatgagagtcgggt

SEQ ID NO: 1869 - DNA, 24 bp, Artificial Sequence
  Description of Artificial Sequence: Synthetic oligonucleotide
gaccgactctcatgagagtcggtc

SEQ ID NO: 1870 - DNA, 24 bp, Artificial Sequence
  Description of Artificial Sequence: Synthetic oligonucleotide
gcacgactctcatgagagtcgtgc

SEQ ID NO: 1871 - DNA, 24 bp, Artificial Sequence
  Description of Artificial Sequence: Synthetic oligonucleotide
gccagactctcatgagagtctggc

SEQ ID NO: 1872 - DNA, 24 bp, Artificial Sequence
  Description of Artificial Sequence: Synthetic oligonucleotide
tcccgactctcatgagagtcggga

SEQ ID NO: 1873 - DNA, 24 bp, Artificial Sequence
  Description of Artificial Sequence: Synthetic oligonucleotide
gtccgactctcatgagagtcggac

SEQ ID NO: 1874 - DNA, 24 bp, Artificial Sequence
  Description of Artificial Sequence: Synthetic oligonucleotide
gcctgactctcatgagagtcaggc

SEQ ID NO: 1875 - DNA, 24 bp, Artificial Sequence
  Description of Artificial Sequence: Synthetic oligonucleotide
gggcgactctcatgagagtcgccc

SEQ ID NO: 1876 - DNA, 24 bp, Artificial Sequence
  Description of Artificial Sequence: Synthetic oligonucleotide
aggcgactctcatgagagtcgcct

SEQ ID NO: 1877 - DNA, 24 bp, Artificial Sequence
  Description of Artificial Sequence: Synthetic oligonucleotide
gagcgactctcatgagagtcgctc

SEQ ID NO: 1878 - DNA, 24 bp, Artificial Sequence
  Description of Artificial Sequence: Synthetic oligonucleotide
ggacgactctcatgagagtcgtcc

SEQ ID NO: 1879 - DNA, 24 bp, Artificial Sequence
  Description of Artificial Sequence: Synthetic oligonucleotide
gggagactctcatgagagtctccc

SEQ ID NO: 1880 - DNA, 24 bp, Artificial Sequence
  Description of Artificial Sequence: Synthetic oligonucleotide
tggcgactctcatgagagtcgcca

SEQ ID NO: 1881 - DNA, 24 bp, Artificial Sequence
  Description of Artificial Sequence: Synthetic oligonucleotide
gtgcgactctcatgagagtcgcac

SEQ ID NO: 1882 - DNA, 24 bp, Artificial Sequence
  Description of Artificial Sequence: Synthetic oligonucleotide
gggtgactctcatgagagtcaccc

SEQ ID NO: 1883 - DNA, 24 bp, Artificial Sequence
  Description of Artificial Sequence: Synthetic oligonucleotide
acgggactctcatgagagtcccgt

SEQ ID NO: 1884 - DNA, 24 bp, Artificial Sequence
  Description of Artificial Sequence: Synthetic oligonucleotide
cagggactctcatgagagtccctg

SEQ ID NO: 1885 - DNA, 24 bp, Artificial Sequence
  Description of Artificial Sequence: Synthetic oligonucleotide
ccaggactctcatgagagtcctgg

SEQ ID NO: 1886 - DNA, 24 bp, Artificial Sequence
  Description of Artificial Sequence: Synthetic oligonucleotide
ccgagactctcatgagagtctcgg

SEQ ID NO: 1887 - DNA, 24 bp, Artificial Sequence
  Description of Artificial Sequence: Synthetic oligonucleotide
tcgggactctcatgagagtcccga

SEQ ID NO: 1888 - DNA, 24 bp, Artificial Sequence
  Description of Artificial Sequence: Synthetic oligonucleotide
ctgggactctcatgagagtcccag

SEQ ID NO: 1889 - DNA, 24 bp, Artificial Sequence
  Description of Artificial Sequence: Synthetic oligonucleotide
cctggactctcatgagagtccagg

SEQ ID NO: 1890 - DNA, 24 bp, Artificial Sequence
  Description of Artificial Sequence: Synthetic oligonucleotide
ccgtgactctcatgagagtcacgg

SEQ ID NO: 1891 - DNA, 24 bp, Artificial Sequence
  Description of Artificial Sequence: Synthetic oligonucleotide
cggcgactctcatgagagtcgccg

SEQ ID NO: 1892 - DNA, 24 bp, Artificial Sequence
  Description of Artificial Sequence: Synthetic oligonucleotide
cagcgactctcatgagagtcgctg

SEQ ID NO: 1893 - DNA, 24 bp, Artificial Sequence
  Description of Artificial Sequence: Synthetic oligonucleotide
cgacgactctcatgagagtcgtcg

SEQ ID NO: 1894 - DNA, 24 bp, Artificial Sequence
  Description of Artificial Sequence: Synthetic oligonucleotide
cggagactctcatgagagtctccg

SEQ ID NO: 1895 - DNA, 24 bp, Artificial Sequence
  Description of Artificial Sequence: Synthetic oligonucleotide
ctgcgactctcatgagagtcgcag

SEQ ID NO: 1896 - DNA, 24 bp, Artificial Sequence
  Description of Artificial Sequence: Synthetic oligonucleotide
cggtgactctcatgagagtcaccg

SEQ ID NO: 1897 - DNA, 24 bp, Artificial Sequence
  Description of Artificial Sequence: Synthetic oligonucleotide
cacggactctcatgagagtccgtg

SEQ ID NO: 1898 - DNA, 24 bp, Artificial Sequence
  Description of Artificial Sequence: Synthetic oligonucleotide
cccagactctcatgagagtctggg

SEQ ID NO: 1899 - DNA, 24 bp, Artificial Sequence
  Description of Artificial Sequence: Synthetic oligonucleotide
ctcggactctcatgagagtccgag

SEQ ID NO: 1900 - DNA, 24 bp, Artificial Sequence
  Description of Artificial Sequence: Synthetic oligonucleotide
ccctgactctcatgagagtcaggg

SEQ ID NO: 1901 - DNA, 24 bp, Artificial Sequence
  Description of Artificial Sequence: Synthetic oligonucleotide
ccacgactctcatgagagtcgtgg

SEQ ID NO: 1902 - DNA, 24 bp, Artificial Sequence
  Description of Artificial Sequence: Synthetic oligonucleotide
agccgactctcatgagagtcggct

SEQ ID NO: 1903 - DNA, 24 bp, Artificial Sequence
  Description of Artificial Sequence: Synthetic oligonucleotide
tgccgactctcatgagagtcggca

SEQ ID NO: 1904 - DNA, 24 bp, Artificial Sequence
  Description of Artificial Sequence: Synthetic oligonucleotide
gcgagactctcatgagagtctcgc

SEQ ID NO: 1905 - DNA, 24 bp, Artificial Sequence
  Description of Artificial Sequence: Synthetic oligonucleotide
gcgtgactctcatgagagtcacgc

SEQ ID NO: 1906 - DNA, 24 bp, Artificial Sequence
  Description of Artificial Sequence: Synthetic oligonucleotide
gcaggactctcatgagagtcctgc

SEQ ID NO: 1907 - DNA, 24 bp, Artificial Sequence
  Description of Artificial Sequence: Synthetic oligonucleotide
gctggactctcatgagagtccagc

SEQ ID NO: 1908 - DNA, 24 bp, Artificial Sequence
  Description of Artificial Sequence: Synthetic oligonucleotide
cgaggactctcatgagagtcctcg

SEQ ID NO: 1909 - DNA, 24 bp, Artificial Sequence
  Description of Artificial Sequence: Synthetic oligonucleotide
cgtggactctcatgagagtccacg

SEQ ID NO: 1910 - DNA, 24 bp, Artificial Sequence
  Description of Artificial Sequence: Synthetic oligonucleotide
caccgactctcatgagagtcggtg

SEQ ID NO: 1911 - DNA, 24 bp, Artificial Sequence
  Description of Artificial Sequence: Synthetic oligonucleotide
ctccgactctcatgagagtcggag

SEQ ID NO: 1912 - DNA, 24 bp, Artificial Sequence
  Description of Artificial Sequence: Synthetic oligonucleotide
gcgggactctcatgagagtcccgc

SEQ ID NO: 1913 - DNA, 24 bp, Artificial Sequence
  Description of Artificial Sequence: Synthetic oligonucleotide
gagggactctcatgagagtccctc

SEQ ID NO: 1914 - DNA, 24 bp, Artificial Sequence
  Description of Artificial Sequence: Synthetic oligonucleotide
gtgggactctcatgagagtcccac

SEQ ID NO: 1915 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctctagagagtcnnnn

SEQ ID NO: 1916 - DNA, 24 bp, Artificial Sequence
  Description of Artificial Sequence: Synthetic oligonucleotide
ggcggactctctagagagtccgcc

SEQ ID NO: 1917 - DNA, 24 bp, Artificial Sequence
  Description of Artificial Sequence: Synthetic oligonucleotide
agcggactctctagagagtccgct

SEQ ID NO: 1918 - DNA, 24 bp, Artificial Sequence
  Description of Artificial Sequence: Synthetic oligonucleotide
gacggactctctagagagtccgtc

SEQ ID NO: 1919 - DNA, 24 bp, Artificial Sequence
  Description of Artificial Sequence: Synthetic oligonucleotide
ggaggactctctagagagtcctcc

SEQ ID NO: 1920 - DNA, 24 bp, Artificial Sequence
  Description of Artificial Sequence: Synthetic oligonucleotide
ggcagactctctagagagtctgcc

SEQ ID NO: 1921 - DNA, 24 bp, Artificial Sequence
  Description of Artificial Sequence: Synthetic oligonucleotide
tgcggactctctagagagtccgca

SEQ ID NO: 1922 - DNA, 24 bp, Artificial Sequence
  Description of Artificial Sequence: Synthetic oligonucleotide
gtcggactctctagagagtccgac

SEQ ID NO: 1923 - DNA, 24 bp, Artificial Sequence
  Description of Artificial Sequence: Synthetic oligonucleotide
ggtggactctctagagagtccacc

SEQ ID NO: 1924 - DNA, 24 bp, Artificial Sequence
  Description of Artificial Sequence: Synthetic oligonucleotide
ggctgactctctagagagtcagcc

SEQ ID NO: 1925 - DNA, 24 bp, Artificial Sequence
  Description of Artificial Sequence: Synthetic oligonucleotide
gcccgactctctagagagtcgggc

SEQ ID NO: 1926 - DNA, 24 bp, Artificial Sequence
  Description of Artificial Sequence: Synthetic oligonucleotide
acccgactctctagagagtcgggt

SEQ ID NO: 1927 - DNA, 24 bp, Artificial Sequence
  Description of Artificial Sequence: Synthetic oligonucleotide
gaccgactctctagagagtcggtc

SEQ ID NO: 1928 - DNA, 24 bp, Artificial Sequence
  Description of Artificial Sequence: Synthetic oligonucleotide
gcacgactctctagagagtcgtgc

SEQ ID NO: 1929 - DNA, 24 bp, Artificial Sequence
  Description of Artificial Sequence: Synthetic oligonucleotide
gccagactctctagagagtctggc

SEQ ID NO: 1930 - DNA, 24 bp, Artificial Sequence
  Description of Artificial Sequence: Synthetic oligonucleotide
tcccgactctctagagagtcggga

SEQ ID NO: 1931 - DNA, 24 bp, Artificial Sequence
  Description of Artificial Sequence: Synthetic oligonucleotide
gtccgactctctagagagtcggac

SEQ ID NO: 1932 - DNA, 24 bp, Artificial Sequence
  Description of Artificial Sequence: Synthetic oligonucleotide
gcctgactctctagagagtcaggc

SEQ ID NO: 1933 - DNA, 24 bp, Artificial Sequence
  Description of Artificial Sequence: Synthetic oligonucleotide
gggcgactctctagagagtcgccc

SEQ ID NO: 1934 - DNA, 24 bp, Artificial Sequence
  Description of Artificial Sequence: Synthetic oligonucleotide
aggcgactctctagagagtcgcct

SEQ ID NO: 1935 - DNA, 24 bp, Artificial Sequence
  Description of Artificial Sequence: Synthetic oligonucleotide
gagcgactctctagagagtcgctc

SEQ ID NO: 1936 - DNA, 24 bp, Artificial Sequence
  Description of Artificial Sequence: Synthetic oligonucleotide
ggacgactctctagagagtcgtcc

SEQ ID NO: 1937 - DNA, 24 bp, Artificial Sequence
  Description of Artificial Sequence: Synthetic oligonucleotide
gggagactctctagagagtctccc

SEQ ID NO: 1938 - DNA, 24 bp, Artificial Sequence
  Description of Artificial Sequence: Synthetic oligonucleotide
tggcgactctctagagagtcgcca

SEQ ID NO: 1939 - DNA, 24 bp, Artificial Sequence
  Description of Artificial Sequence: Synthetic oligonucleotide
gtgcgactctctagagagtcgcac

SEQ ID NO: 1940 - DNA, 24 bp, Artificial Sequence
  Description of Artificial Sequence: Synthetic oligonucleotide
gggtgactctctagagagtcaccc

SEQ ID NO: 1941 - DNA, 24 bp, Artificial Sequence
  Description of Artificial Sequence: Synthetic oligonucleotide
acgggactctctagagagtcccgt

SEQ ID NO: 1942 - DNA, 24 bp, Artificial Sequence
  Description of Artificial Sequence: Synthetic oligonucleotide
cagggactctctagagagtccctg

SEQ ID NO: 1943 - DNA, 24 bp, Artificial Sequence
  Description of Artificial Sequence: Synthetic oligonucleotide
ccaggactctctagagagtcctgg

SEQ ID NO: 1944 - DNA, 24 bp, Artificial Sequence
  Description of Artificial Sequence: Synthetic oligonucleotide
ccgagactctctagagagtctcgg

SEQ ID NO: 1945 - DNA, 24 bp, Artificial Sequence
  Description of Artificial Sequence: Synthetic oligonucleotide
tcgggactctctagagagtcccga

SEQ ID NO: 1946 - DNA, 24 bp, Artificial Sequence
  Description of Artificial Sequence: Synthetic oligonucleotide
ctgggactctctagagagtcccag

SEQ ID NO: 1947 - DNA, 24 bp, Artificial Sequence
  Description of Artificial Sequence: Synthetic oligonucleotide
cctggactctctagagagtccagg

SEQ ID NO: 1948 - DNA, 24 bp, Artificial Sequence
  Description of Artificial Sequence: Synthetic oligonucleotide
ccgtgactctctagagagtcacgg

SEQ ID NO: 1949 - DNA, 24 bp, Artificial Sequence
  Description of Artificial Sequence: Synthetic oligonucleotide
cggcgactctctagagagtcgccg

SEQ ID NO: 1950 - DNA, 24 bp, Artificial Sequence
  Description of Artificial Sequence: Synthetic oligonucleotide
cagcgactctctagagagtcgctg

SEQ ID NO: 1951 - DNA, 24 bp, Artificial Sequence
  Description of Artificial Sequence: Synthetic oligonucleotide
cgacgactctctagagagtcgtcg

SEQ ID NO: 1952 - DNA, 24 bp, Artificial Sequence
  Description of Artificial Sequence: Synthetic oligonucleotide
cggagactctctagagagtctccg

SEQ ID NO: 1953 - DNA, 24 bp, Artificial Sequence
  Description of Artificial Sequence: Synthetic oligonucleotide
ctgcgactctctagagagtcgcag

SEQ ID NO: 1954 - DNA, 24 bp, Artificial Sequence
  Description of Artificial Sequence: Synthetic oligonucleotide
cggtgactctctagagagtcaccg

SEQ ID NO: 1955 - DNA, 24 bp, Artificial Sequence
  Description of Artificial Sequence: Synthetic oligonucleotide
cacggactctctagagagtccgtg

SEQ ID NO: 1956 - DNA, 24 bp, Artificial Sequence
  Description of Artificial Sequence: Synthetic oligonucleotide
cccagactctctagagagtctggg

SEQ ID NO: 1957 - DNA, 24 bp, Artificial Sequence
  Description of Artificial Sequence: Synthetic oligonucleotide
ctcggactctctagagagtccgag

SEQ ID NO: 1958 - DNA, 24 bp, Artificial Sequence
  Description of Artificial Sequence: Synthetic oligonucleotide
ccctgactctctagagagtcaggg

SEQ ID NO: 1959 - DNA, 24 bp, Artificial Sequence
  Description of Artificial Sequence: Synthetic oligonucleotide
ccacgactctctagagagtcgtgg

SEQ ID NO: 1960 - DNA, 24 bp, Artificial Sequence
  Description of Artificial Sequence: Synthetic oligonucleotide
agccgactctctagagagtcggct

SEQ ID NO: 1961 - DNA, 24 bp, Artificial Sequence
  Description of Artificial Sequence: Synthetic oligonucleotide
tgccgactctctagagagtcggca

SEQ ID NO: 1962 - DNA, 24 bp, Artificial Sequence
  Description of Artificial Sequence: Synthetic oligonucleotide
gcgagactctctagagagtctcgc

SEQ ID NO: 1963 - DNA, 24 bp, Artificial Sequence
  Description of Artificial Sequence: Synthetic oligonucleotide
gcgtgactctctagagagtcacgc

SEQ ID NO: 1964 - DNA, 24 bp, Artificial Sequence
  Description of Artificial Sequence: Synthetic oligonucleotide
gcaggactctctagagagtcctgc

SEQ ID NO: 1965 - DNA, 24 bp, Artificial Sequence
  Description of Artificial Sequence: Synthetic oligonucleotide
gctggactctctagagagtccagc

SEQ ID NO: 1966 - DNA, 24 bp, Artificial Sequence
  Description of Artificial Sequence: Synthetic oligonucleotide
cgaggactctctagagagtcctcg

SEQ ID NO: 1967 - DNA, 24 bp, Artificial Sequence
  Description of Artificial Sequence: Synthetic oligonucleotide
cgtggactctctagagagtccacg

SEQ ID NO: 1968 - DNA, 24 bp, Artificial Sequence
  Description of Artificial Sequence: Synthetic oligonucleotide
caccgactctctagagagtcggtg

SEQ ID NO: 1969 - DNA, 24 bp, Artificial Sequence
  Description of Artificial Sequence: Synthetic oligonucleotide
ctccgactctctagagagtcggag

SEQ ID NO: 1970 - DNA, 24 bp, Artificial Sequence
  Description of Artificial Sequence: Synthetic oligonucleotide
gcgggactctctagagagtcccgc

SEQ ID NO: 1971 - DNA, 24 bp, Artificial Sequence
  Description of Artificial Sequence: Synthetic oligonucleotide
gagggactctctagagagtccctc

SEQ ID NO: 1972 - DNA, 24 bp, Artificial Sequence
  Description of Artificial Sequence: Synthetic oligonucleotide
gtgggactctctagagagtcccac

SEQ ID NO: 1973 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctcgcgagagtcnnnn

SEQ ID NO: 1974 - DNA, 24 bp, Artificial Sequence
  Description of Artificial Sequence: Synthetic oligonucleotide
ggcggactctcgcgagagtccgcc

SEQ ID NO: 1975 - DNA, 24 bp, Artificial Sequence
  Description of Artificial Sequence: Synthetic oligonucleotide
agcggactctcgcgagagtccgct

SEQ ID NO: 1976 - DNA, 24 bp, Artificial Sequence
  Description of Artificial Sequence: Synthetic oligonucleotide
gacggactctcgcgagagtccgtc

SEQ ID NO: 1977 - DNA, 24 bp, Artificial Sequence
  Description of Artificial Sequence: Synthetic oligonucleotide
ggaggactctcgcgagagtcctcc

SEQ ID NO: 1978 - DNA, 24 bp, Artificial Sequence
  Description of Artificial Sequence: Synthetic oligonucleotide
ggcagactctcgcgagagtctgcc

SEQ ID NO: 1979 - DNA, 24 bp, Artificial Sequence
  Description of Artificial Sequence: Synthetic oligonucleotide
tgcggactctcgcgagagtccgca

SEQ ID NO: 1980 - DNA, 24 bp, Artificial Sequence
  Description of Artificial Sequence: Synthetic oligonucleotide
gtcggactctcgcgagagtccgac

SEQ ID NO: 1981 - DNA, 24 bp, Artificial Sequence
  Description of Artificial Sequence: Synthetic oligonucleotide
ggtggactctcgcgagagtccacc

SEQ ID NO: 1982 - DNA, 24 bp, Artificial Sequence
  Description of Artificial Sequence: Synthetic oligonucleotide
ggctgactctcgcgagagtcagcc

SEQ ID NO: 1983 - DNA, 24 bp, Artificial Sequence
  Description of Artificial Sequence: Synthetic oligonucleotide
gcccgactctcgcgagagtcgggc

SEQ ID NO: 1984 - DNA, 24 bp, Artificial Sequence
  Description of Artificial Sequence: Synthetic oligonucleotide
acccgactctcgcgagagtcgggt

SEQ ID NO: 1985 - DNA, 24 bp, Artificial Sequence
  Description of Artificial Sequence: Synthetic oligonucleotide
gaccgactctcgcgagagtcggtc

SEQ ID NO: 1986 - DNA, 24 bp, Artificial Sequence
  Description of Artificial Sequence: Synthetic oligonucleotide
gcacgactctcgcgagagtcgtgc

SEQ ID NO: 1987 - DNA, 24 bp, Artificial Sequence
  Description of Artificial Sequence: Synthetic oligonucleotide
gccagactctcgcgagagtctggc

SEQ ID NO: 1988 - DNA, 24 bp, Artificial Sequence
  Description of Artificial Sequence: Synthetic oligonucleotide
tcccgactctcgcgagagtcggga

SEQ ID NO: 1989 - DNA, 24 bp, Artificial Sequence
  Description of Artificial Sequence: Synthetic oligonucleotide
gtccgactctcgcgagagtcggac

SEQ ID NO: 1990 - DNA, 24 bp, Artificial Sequence
  Description of Artificial Sequence: Synthetic oligonucleotide
gcctgactctcgcgagagtcaggc

SEQ ID NO: 1991 - DNA, 24 bp, Artificial Sequence
  Description of Artificial Sequence: Synthetic oligonucleotide
gggcgactctcgcgagagtcgccc

SEQ ID NO: 1992 - DNA, 24 bp, Artificial Sequence
  Description of Artificial Sequence: Synthetic oligonucleotide
aggcgactctcgcgagagtcgcct

SEQ ID NO: 1993 - DNA, 24 bp, Artificial Sequence
  Description of Artificial Sequence: Synthetic oligonucleotide
gagcgactctcgcgagagtcgctc

SEQ ID NO: 1994 - DNA, 24 bp, Artificial Sequence
  Description of Artificial Sequence: Synthetic oligonucleotide
ggacgactctcgcgagagtcgtcc

SEQ ID NO: 1995 - DNA, 24 bp, Artificial Sequence
  Description of Artificial Sequence: Synthetic oligonucleotide
gggagactctcgcgagagtctccc

SEQ ID NO: 1996 - DNA, 24 bp, Artificial Sequence
  Description of Artificial Sequence: Synthetic oligonucleotide
tggcgactctcgcgagagtcgcca

SEQ ID NO: 1997 - DNA, 24 bp, Artificial Sequence
  Description of Artificial Sequence: Synthetic oligonucleotide
gtgcgactctcgcgagagtcgcac

SEQ ID NO: 1998 - DNA, 24 bp, Artificial Sequence
  Description of Artificial Sequence: Synthetic oligonucleotide
gggtgactctcgcgagagtcaccc

SEQ ID NO: 1999 - DNA, 24 bp, Artificial Sequence
  Description of Artificial Sequence: Synthetic oligonucleotide
acgggactctcgcgagagtcccgt

SEQ ID NO: 2000 - DNA, 24 bp, Artificial Sequence
  Description of Artificial Sequence: Synthetic oligonucleotide
cagggactctcgcgagagtccctg

SEQ ID NO: 2001 - DNA, 24 bp, Artificial Sequence
  Description of Artificial Sequence: Synthetic oligonucleotide
ccaggactctcgcgagagtcctgg

SEQ ID NO: 2002 - DNA, 24 bp, Artificial Sequence
  Description of Artificial Sequence: Synthetic oligonucleotide
ccgagactctcgcgagagtctcgg

SEQ ID NO: 2003 - DNA, 24 bp, Artificial Sequence
  Description of Artificial Sequence: Synthetic oligonucleotide
tcgggactctcgcgagagtcccga

SEQ ID NO: 2004 - DNA, 24 bp, Artificial Sequence
  Description of Artificial Sequence: Synthetic oligonucleotide
ctgggactctcgcgagagtcccag

SEQ ID NO: 2005 - DNA, 24 bp, Artificial Sequence
  Description of Artificial Sequence: Synthetic oligonucleotide
cctggactctcgcgagagtccagg

SEQ ID NO: 2006 - DNA, 24 bp, Artificial Sequence
  Description of Artificial Sequence: Synthetic oligonucleotide
ccgtgactctcgcgagagtcacgg

SEQ ID NO: 2007 - DNA, 24 bp, Artificial Sequence
  Description of Artificial Sequence: Synthetic oligonucleotide
cggcgactctcgcgagagtcgccg

SEQ ID NO: 2008 - DNA, 24 bp, Artificial Sequence
  Description of Artificial Sequence: Synthetic oligonucleotide
cagcgactctcgcgagagtcgctg

SEQ ID NO: 2009 - DNA, 24 bp, Artificial Sequence
  Description of Artificial Sequence: Synthetic oligonucleotide
cgacgactctcgcgagagtcgtcg

SEQ ID NO: 2010 - DNA, 24 bp, Artificial Sequence
  Description of Artificial Sequence: Synthetic oligonucleotide
cggagactctcgcgagagtctccg

SEQ ID NO: 2011 - DNA, 24 bp, Artificial Sequence
  Description of Artificial Sequence: Synthetic oligonucleotide
ctgcgactctcgcgagagtcgcag

SEQ ID NO: 2012 - DNA, 24 bp, Artificial Sequence
  Description of Artificial Sequence: Synthetic oligonucleotide
cggtgactctcgcgagagtcaccg

SEQ ID NO: 2013 - DNA, 24 bp, Artificial Sequence
  Description of Artificial Sequence: Synthetic oligonucleotide
cacggactctcgcgagagtccgtg

SEQ ID NO: 2014 - DNA, 24 bp, Artificial Sequence
  Description of Artificial Sequence: Synthetic oligonucleotide
cccagactctcgcgagagtctggg

SEQ ID NO: 2015 - DNA, 24 bp, Artificial Sequence
  Description of Artificial Sequence: Synthetic oligonucleotide
ctcggactctcgcgagagtccgag

SEQ ID NO: 2016 - DNA, 24 bp, Artificial Sequence
  Description of Artificial Sequence: Synthetic oligonucleotide
ccctgactctcgcgagagtcaggg

SEQ ID NO: 2017 - DNA, 24 bp, Artificial Sequence
  Description of Artificial Sequence: Synthetic oligonucleotide
ccacgactctcgcgagagtcgtgg

SEQ ID NO: 2018 - DNA, 24 bp, Artificial Sequence
  Description of Artificial Sequence: Synthetic oligonucleotide
agccgactctcgcgagagtcggct

SEQ ID NO: 2019 - DNA, 24 bp, Artificial Sequence
  Description of Artificial Sequence: Synthetic oligonucleotide
tgccgactctcgcgagagtcggca

SEQ ID NO: 2020 - DNA, 24 bp, Artificial Sequence
  Description of Artificial Sequence: Synthetic oligonucleotide
gcgagactctcgcgagagtctcgc

SEQ ID NO: 2021 - DNA, 24 bp, Artificial Sequence
  Description of Artificial Sequence: Synthetic oligonucleotide
gcgtgactctcgcgagagtcacgc

SEQ ID NO: 2022 - DNA, 24 bp, Artificial Sequence
  Description of Artificial Sequence: Synthetic oligonucleotide
gcaggactctcgcgagagtcctgc

SEQ ID NO: 2023 - DNA, 24 bp, Artificial Sequence
  Description of Artificial Sequence: Synthetic oligonucleotide
gctggactctcgcgagagtccagc

SEQ ID NO: 2024 - DNA, 24 bp, Artificial Sequence
  Description of Artificial Sequence: Synthetic oligonucleotide
cgaggactctcgcgagagtcctcg

SEQ ID NO: 2025 - DNA, 24 bp, Artificial Sequence
  Description of Artificial Sequence: Synthetic oligonucleotide
cgtggactctcgcgagagtccacg

SEQ ID NO: 2026 - DNA, 24 bp, Artificial Sequence
  Description of Artificial Sequence: Synthetic oligonucleotide
caccgactctcgcgagagtcggtg

SEQ ID NO: 2027 - DNA, 24 bp, Artificial Sequence
  Description of Artificial Sequence: Synthetic oligonucleotide
ctccgactctcgcgagagtcggag

SEQ ID NO: 2028 - DNA, 24 bp, Artificial Sequence
  Description of Artificial Sequence: Synthetic oligonucleotide
gcgggactctcgcgagagtcccgc

SEQ ID NO: 2029 - DNA, 24 bp, Artificial Sequence
  Description of Artificial Sequence: Synthetic oligonucleotide
gagggactctcgcgagagtccctc

SEQ ID NO: 2030 - DNA, 24 bp, Artificial Sequence
  Description of Artificial Sequence: Synthetic oligonucleotide
gtgggactctcgcgagagtcccac

SEQ ID NO: 2031 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctccggagagtcnnnn

SEQ ID NO: 2032 - DNA, 24 bp, Artificial Sequence
  Description of Artificial Sequence: Synthetic oligonucleotide
ggcggactctccggagagtccgcc

SEQ ID NO: 2033 - DNA, 24 bp, Artificial Sequence
  Description of Artificial Sequence: Synthetic oligonucleotide
agcggactctccggagagtccgct

SEQ ID NO: 2034 - DNA, 24 bp, Artificial Sequence
  Description of Artificial Sequence: Synthetic oligonucleotide
gacggactctccggagagtccgtc

SEQ ID NO: 2035 - DNA, 24 bp, Artificial Sequence
  Description of Artificial Sequence: Synthetic oligonucleotide
ggaggactctccggagagtcctcc

SEQ ID NO: 2036 - DNA, 24 bp, Artificial Sequence
  Description of Artificial Sequence: Synthetic oligonucleotide
ggcagactctccggagagtctgcc

SEQ ID NO: 2037 - DNA, 24 bp, Artificial Sequence
  Description of Artificial Sequence: Synthetic oligonucleotide
tgcggactctccggagagtccgca

SEQ ID NO: 2038 - DNA, 24 bp, Artificial Sequence
  Description of Artificial Sequence: Synthetic oligonucleotide
gtcggactctccggagagtccgac

SEQ ID NO: 2039 - DNA, 24 bp, Artificial Sequence
  Description of Artificial Sequence: Synthetic oligonucleotide
ggtggactctccggagagtccacc

SEQ ID NO: 2040 - DNA, 24 bp, Artificial Sequence
  Description of Artificial Sequence: Synthetic oligonucleotide
ggctgactctccggagagtcagcc

SEQ ID NO: 2041 - DNA, 24 bp, Artificial Sequence
  Description of Artificial Sequence: Synthetic oligonucleotide
gcccgactctccggagagtcgggc

SEQ ID NO: 2042 - DNA, 24 bp, Artificial Sequence
  Description of Artificial Sequence: Synthetic oligonucleotide
acccgactctccggagagtcgggt

SEQ ID NO: 2043 - DNA, 24 bp, Artificial Sequence
  Description of Artificial Sequence: Synthetic oligonucleotide
gaccgactctccggagagtcggtc

SEQ ID NO: 2044 - DNA, 24 bp, Artificial Sequence
  Description of Artificial Sequence: Synthetic oligonucleotide
gcacgactctccggagagtcgtgc

SEQ ID NO: 2045 - DNA, 24 bp, Artificial Sequence
  Description of Artificial Sequence: Synthetic oligonucleotide
gccagactctccggagagtctggc

SEQ ID NO: 2046 - DNA, 24 bp, Artificial Sequence
  Description of Artificial Sequence: Synthetic oligonucleotide
tcccgactctccggagagtcggga

SEQ ID NO: 2047 - DNA, 24 bp, Artificial Sequence
  Description of Artificial Sequence: Synthetic oligonucleotide
gtccgactctccggagagtcggac

SEQ ID NO: 2048 - DNA, 24 bp, Artificial Sequence
  Description of Artificial Sequence: Synthetic oligonucleotide
gcctgactctccggagagtcaggc

SEQ ID NO: 2049 - DNA, 24 bp, Artificial Sequence
  Description of Artificial Sequence: Synthetic oligonucleotide
gggcgactctccggagagtcgccc

SEQ ID NO: 2050 - DNA, 24 bp, Artificial Sequence
  Description of Artificial Sequence: Synthetic oligonucleotide
aggcgactctccggagagtcgcct

SEQ ID NO: 2051 - DNA, 24 bp, Artificial Sequence
  Description of Artificial Sequence: Synthetic oligonucleotide
gagcgactctccggagagtcgctc

SEQ ID NO: 2052 - DNA, 24 bp, Artificial Sequence
  Description of Artificial Sequence: Synthetic oligonucleotide
ggacgactctccggagagtcgtcc

SEQ ID NO: 2053 - DNA, 24 bp, Artificial Sequence
  Description of Artificial Sequence: Synthetic oligonucleotide
gggagactctccggagagtctccc

SEQ ID NO: 2054 - DNA, 24 bp, Artificial Sequence
  Description of Artificial Sequence: Synthetic oligonucleotide
tggcgactctccggagagtcgcca

SEQ ID NO: 2055 - DNA, 24 bp, Artificial Sequence
  Description of Artificial Sequence: Synthetic oligonucleotide
gtgcgactctccggagagtcgcac

SEQ ID NO: 2056 - DNA, 24 bp, Artificial Sequence
  Description of Artificial Sequence: Synthetic oligonucleotide
gggtgactctccggagagtcaccc

SEQ ID NO: 2057 - DNA, 24 bp, Artificial Sequence
  Description of Artificial Sequence: Synthetic oligonucleotide
acgggactctccggagagtcccgt

SEQ ID NO: 2058 - DNA, 24 bp, Artificial Sequence
  Description of Artificial Sequence: Synthetic oligonucleotide
cagggactctccggagagtccctg

SEQ ID NO: 2059 - DNA, 24 bp, Artificial Sequence
  Description of Artificial Sequence: Synthetic oligonucleotide
ccaggactctccggagagtcctgg

SEQ ID NO: 2060 - DNA, 24 bp, Artificial Sequence
  Description of Artificial Sequence: Synthetic oligonucleotide
ccgagactctccggagagtctcgg

SEQ ID NO: 2061 - DNA, 24 bp, Artificial Sequence
  Description of Artificial Sequence: Synthetic oligonucleotide
tcgggactctccggagagtcccga

SEQ ID NO: 2062 - DNA, 24 bp, Artificial Sequence
  Description of Artificial Sequence: Synthetic oligonucleotide
ctgggactctccggagagtcccag

SEQ ID NO: 2063 - DNA, 24 bp, Artificial Sequence
  Description of Artificial Sequence: Synthetic oligonucleotide
cctggactctccggagagtccagg

SEQ ID NO: 2064 - DNA, 24 bp, Artificial Sequence
  Description of Artificial Sequence: Synthetic oligonucleotide
ccgtgactctccggagagtcacgg

SEQ ID NO: 2065 - DNA, 24 bp, Artificial Sequence
  Description of Artificial Sequence: Synthetic oligonucleotide
cggcgactctccggagagtcgccg

SEQ ID NO: 2066 - DNA, 24 bp, Artificial Sequence
  Description of Artificial Sequence: Synthetic oligonucleotide
cagcgactctccggagagtcgctg

SEQ ID NO: 2067 - DNA, 24 bp, Artificial Sequence
  Description of Artificial Sequence: Synthetic oligonucleotide
cgacgactctccggagagtcgtcg

SEQ ID NO: 2068 - DNA, 24 bp, Artificial Sequence
  Description of Artificial Sequence: Synthetic oligonucleotide
cggagactctccggagagtctccg

SEQ ID NO: 2069 - DNA, 24 bp, Artificial Sequence
  Description of Artificial Sequence: Synthetic oligonucleotide
ctgcgactctccggagagtcgcag

SEQ ID NO: 2070 - DNA, 24 bp, Artificial Sequence
  Description of Artificial Sequence: Synthetic oligonucleotide
cggtgactctccggagagtcaccg

SEQ ID NO: 2071 - DNA, 24 bp, Artificial Sequence
  Description of Artificial Sequence: Synthetic oligonucleotide
cacggactctccggagagtccgtg

SEQ ID NO: 2072 - DNA, 24 bp, Artificial Sequence
  Description of Artificial Sequence: Synthetic oligonucleotide
cccagactctccggagagtctggg

SEQ ID NO: 2073 - DNA, 24 bp, Artificial Sequence
  Description of Artificial Sequence: Synthetic oligonucleotide
ctcggactctccggagagtccgag

SEQ ID NO: 2074 - DNA, 24 bp, Artificial Sequence
  Description of Artificial Sequence: Synthetic oligonucleotide
ccctgactctccggagagtcaggg

SEQ ID NO: 2075 - DNA, 24 bp, Artificial Sequence
  Description of Artificial Sequence: Synthetic oligonucleotide
ccacgactctccggagagtcgtgg

SEQ ID NO: 2076 - DNA, 24 bp, Artificial Sequence
  Description of Artificial Sequence: Synthetic oligonucleotide
agccgactctccggagagtcggct

SEQ ID NO: 2077 - DNA, 24 bp, Artificial Sequence
  Description of Artificial Sequence: Synthetic oligonucleotide
tgccgactctccggagagtcggca

SEQ ID NO: 2078 - DNA, 24 bp, Artificial Sequence
  Description of Artificial Sequence: Synthetic oligonucleotide
gcgagactctccggagagtctcgc

SEQ ID NO: 2079 - DNA, 24 bp, Artificial Sequence
  Description of Artificial Sequence: Synthetic oligonucleotide
gcgtgactctccggagagtcacgc

SEQ ID NO: 2080 - DNA, 24 bp, Artificial Sequence
  Description of Artificial Sequence: Synthetic oligonucleotide
gcaggactctccggagagtcctgc

SEQ ID NO: 2081 - DNA, 24 bp, Artificial Sequence
  Description of Artificial Sequence: Synthetic oligonucleotide
gctggactctccggagagtccagc

SEQ ID NO: 2082 - DNA, 24 bp, Artificial Sequence
  Description of Artificial Sequence: Synthetic oligonucleotide
cgaggactctccggagagtcctcg

SEQ ID NO: 2083 - DNA, 24 bp, Artificial Sequence
  Description of Artificial Sequence: Synthetic oligonucleotide
cgtggactctccggagagtccacg

SEQ ID NO: 2084 - DNA, 24 bp, Artificial Sequence
  Description of Artificial Sequence: Synthetic oligonucleotide
caccgactctccggagagtcggtg

SEQ ID NO: 2085 - DNA, 24 bp, Artificial Sequence
  Description of Artificial Sequence: Synthetic oligonucleotide
ctccgactctccggagagtcggag

SEQ ID NO: 2086 - DNA, 24 bp, Artificial Sequence
  Description of Artificial Sequence: Synthetic oligonucleotide
gcgggactctccggagagtcccgc

SEQ ID NO: 2087 - DNA, 24 bp, Artificial Sequence
  Description of Artificial Sequence: Synthetic oligonucleotide
gagggactctccggagagtccctc

SEQ ID NO: 2088 - DNA, 24 bp, Artificial Sequence
  Description of Artificial Sequence: Synthetic oligonucleotide
gtgggactctccggagagtcccac

SEQ ID NO: 2089 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcagatctgagtcnnnn

SEQ ID NO: 2090 - DNA, 24 bp, Artificial Sequence
  Description of Artificial Sequence: Synthetic oligonucleotide
ggcggactcagatctgagtccgcc

SEQ ID NO: 2091 - DNA, 24 bp, Artificial Sequence
  Description of Artificial Sequence: Synthetic oligonucleotide
agcggactcagatctgagtccgct

SEQ ID NO: 2092 - DNA, 24 bp, Artificial Sequence
  Description of Artificial Sequence: Synthetic oligonucleotide
gacggactcagatctgagtccgtc

SEQ ID NO: 2093 - DNA, 24 bp, Artificial Sequence
  Description of Artificial Sequence: Synthetic oligonucleotide
ggaggactcagatctgagtcctcc

SEQ ID NO: 2094 - DNA, 24 bp, Artificial Sequence
  Description of Artificial Sequence: Synthetic oligonucleotide
ggcagactcagatctgagtctgcc

SEQ ID NO: 2095 - DNA, 24 bp, Artificial Sequence
  Description of Artificial Sequence: Synthetic oligonucleotide
tgcggactcagatctgagtccgca

SEQ ID NO: 2096 - DNA, 24 bp, Artificial Sequence
  Description of Artificial Sequence: Synthetic oligonucleotide
gtcggactcagatctgagtccgac

SEQ ID NO: 2097 - DNA, 24 bp, Artificial Sequence
  Description of Artificial Sequence: Synthetic oligonucleotide
ggtggactcagatctgagtccacc

SEQ ID NO: 2098 - DNA, 24 bp, Artificial Sequence
  Description of Artificial Sequence: Synthetic oligonucleotide
ggctgactcagatctgagtcagcc

SEQ ID NO: 2099 - DNA, 24 bp, Artificial Sequence
  Description of Artificial Sequence: Synthetic oligonucleotide
gcccgactcagatctgagtcgggc

SEQ ID NO: 2100 - DNA, 24 bp, Artificial Sequence
  Description of Artificial Sequence: Synthetic oligonucleotide
acccgactcagatctgagtcgggt

SEQ ID NO: 2101 - DNA, 24 bp, Artificial Sequence
  Description of Artificial Sequence: Synthetic oligonucleotide
gaccgactcagatctgagtcggtc

SEQ ID NO: 2102 - DNA, 24 bp, Artificial Sequence
  Description of Artificial Sequence: Synthetic oligonucleotide
gcacgactcagatctgagtcgtgc

SEQ ID NO: 2103 - DNA, 24 bp, Artificial Sequence
  Description of Artificial Sequence: Synthetic oligonucleotide
gccagactcagatctgagtctggc

SEQ ID NO: 2104 - DNA, 24 bp, Artificial Sequence
  Description of Artificial Sequence: Synthetic oligonucleotide
tcccgactcagatctgagtcggga

SEQ ID NO: 2105 - DNA, 24 bp, Artificial Sequence
  Description of Artificial Sequence: Synthetic oligonucleotide
gtccgactcagatctgagtcggac

SEQ ID NO: 2106 - DNA, 24 bp, Artificial Sequence
  Description of Artificial Sequence: Synthetic oligonucleotide
gcctgactcagatctgagtcaggc

SEQ ID NO: 2107 - DNA, 24 bp, Artificial Sequence
  Description of Artificial Sequence: Synthetic oligonucleotide
gggcgactcagatctgagtcgccc

SEQ ID NO: 2108 - DNA, 24 bp, Artificial Sequence
  Description of Artificial Sequence: Synthetic oligonucleotide
aggcgactcagatctgagtcgcct

SEQ ID NO: 2109 - DNA, 24 bp, Artificial Sequence
  Description of Artificial Sequence: Synthetic oligonucleotide
gagcgactcagatctgagtcgctc

SEQ ID NO: 2110 - DNA, 24 bp, Artificial Sequence
  Description of Artificial Sequence: Synthetic oligonucleotide
ggacgactcagatctgagtcgtcc

SEQ ID NO: 2111 - DNA, 24 bp, Artificial Sequence
  Description of Artificial Sequence: Synthetic oligonucleotide
gggagactcagatctgagtctccc

SEQ ID NO: 2112 - DNA, 24 bp, Artificial Sequence
  Description of Artificial Sequence: Synthetic oligonucleotide
tggcgactcagatctgagtcgcca

SEQ ID NO: 2113 - DNA, 24 bp, Artificial Sequence
  Description of Artificial Sequence: Synthetic oligonucleotide
gtgcgactcagatctgagtcgcac

SEQ ID NO: 2114 - DNA, 24 bp, Artificial Sequence
  Description of Artificial Sequence: Synthetic oligonucleotide
gggtgactcagatctgagtcaccc

SEQ ID NO: 2115 - DNA, 24 bp, Artificial Sequence
  Description of Artificial Sequence: Synthetic oligonucleotide
acgggactcagatctgagtcccgt

SEQ ID NO: 2116 - DNA, 24 bp, Artificial Sequence
  Description of Artificial Sequence: Synthetic oligonucleotide
cagggactcagatctgagtccctg

SEQ ID NO: 2117 - DNA, 24 bp, Artificial Sequence
  Description of Artificial Sequence: Synthetic oligonucleotide
ccaggactcagatctgagtcctgg

SEQ ID NO: 2118 - DNA, 24 bp, Artificial Sequence
  Description of Artificial Sequence: Synthetic oligonucleotide
ccgagactcagatctgagtctcgg

SEQ ID NO: 2119 - DNA, 24 bp, Artificial Sequence
  Description of Artificial Sequence: Synthetic oligonucleotide
tcgggactcagatctgagtcccga

SEQ ID NO: 2120 - DNA, 24 bp, Artificial Sequence
  Description of Artificial Sequence: Synthetic oligonucleotide
ctgggactcagatctgagtcccag

SEQ ID NO: 2121 - DNA, 24 bp, Artificial Sequence
  Description of Artificial Sequence: Synthetic oligonucleotide
cctggactcagatctgagtccagg

SEQ ID NO: 2122 - DNA, 24 bp, Artificial Sequence
  Description of Artificial Sequence: Synthetic oligonucleotide
ccgtgactcagatctgagtcacgg

SEQ ID NO: 2123 - DNA, 24 bp, Artificial Sequence
  Description of Artificial Sequence: Synthetic oligonucleotide
cggcgactcagatctgagtcgccg

SEQ ID NO: 2124 - DNA, 24 bp, Artificial Sequence
  Description of Artificial Sequence: Synthetic oligonucleotide
cagcgactcagatctgagtcgctg

SEQ ID NO: 2125 - DNA, 24 bp, Artificial Sequence
  Description of Artificial Sequence: Synthetic oligonucleotide
cgacgactcagatctgagtcgtcg

SEQ ID NO: 2126 - DNA, 24 bp, Artificial Sequence
  Description of Artificial Sequence: Synthetic oligonucleotide
cggagactcagatctgagtctccg

SEQ ID NO: 2127 - DNA, 24 bp, Artificial Sequence
  Description of Artificial Sequence: Synthetic oligonucleotide
ctgcgactcagatctgagtcgcag

SEQ ID NO: 2128 - DNA, 24 bp, Artificial Sequence
  Description of Artificial Sequence: Synthetic oligonucleotide
cggtgactcagatctgagtcaccg

SEQ ID NO: 2129 - DNA, 24 bp, Artificial Sequence
  Description of Artificial Sequence: Synthetic oligonucleotide
cacggactcagatctgagtccgtg

SEQ ID NO: 2130 - DNA, 24 bp, Artificial Sequence
  Description of Artificial Sequence: Synthetic oligonucleotide
cccagactcagatctgagtctggg

SEQ ID NO: 2131 - DNA, 24 bp, Artificial Sequence
  Description of Artificial Sequence: Synthetic oligonucleotide
ctcggactcagatctgagtccgag

SEQ ID NO: 2132 - DNA, 24 bp, Artificial Sequence
  Description of Artificial Sequence: Synthetic oligonucleotide
ccctgactcagatctgagtcaggg

SEQ ID NO: 2133 - DNA, 24 bp, Artificial Sequence
  Description of Artificial Sequence: Synthetic oligonucleotide
ccacgactcagatctgagtcgtgg

SEQ ID NO: 2134 - DNA, 24 bp, Artificial Sequence
  Description of Artificial Sequence: Synthetic oligonucleotide
agccgactcagatctgagtcggct

SEQ ID NO: 2135 - DNA, 24 bp, Artificial Sequence
  Description of Artificial Sequence: Synthetic oligonucleotide
tgccgactcagatctgagtcggca

SEQ ID NO: 2136 - DNA, 24 bp, Artificial Sequence
  Description of Artificial Sequence: Synthetic oligonucleotide
gcgagactcagatctgagtctcgc

SEQ ID NO: 2137 - DNA, 24 bp, Artificial Sequence
  Description of Artificial Sequence: Synthetic oligonucleotide
gcgtgactcagatctgagtcacgc

SEQ ID NO: 2138 - DNA, 24 bp, Artificial Sequence
  Description of Artificial Sequence: Synthetic oligonucleotide
gcaggactcagatctgagtcctgc

SEQ ID NO: 2139 - DNA, 24 bp, Artificial Sequence
  Description of Artificial Sequence: Synthetic oligonucleotide
gctggactcagatctgagtccagc

SEQ ID NO: 2140 - DNA, 24 bp, Artificial Sequence
  Description of Artificial Sequence: Synthetic oligonucleotide
cgaggactcagatctgagtcctcg

SEQ ID NO: 2141 - DNA, 24 bp, Artificial Sequence
  Description of Artificial Sequence: Synthetic oligonucleotide
cgtggactcagatctgagtccacg

SEQ ID NO: 2142 - DNA, 24 bp, Artificial Sequence
  Description of Artificial Sequence: Synthetic oligonucleotide
caccgactcagatctgagtcggtg

SEQ ID NO: 2143 - DNA, 24 bp, Artificial Sequence
  Description of Artificial Sequence: Synthetic oligonucleotide
ctccgactcagatctgagtcggag

SEQ ID NO: 2144 - DNA, 24 bp, Artificial Sequence
  Description of Artificial Sequence: Synthetic oligonucleotide
gcgggactcagatctgagtcccgc

SEQ ID NO: 2145 - DNA, 24 bp, Artificial Sequence
  Description of Artificial Sequence: Synthetic oligonucleotide
gagggactcagatctgagtccctc

SEQ ID NO: 2146 - DNA, 24 bp, Artificial Sequence
  Description of Artificial Sequence: Synthetic oligonucleotide
gtgggactcagatctgagtcccac

SEQ ID NO: 2147 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcagtactgagtcnnnn

SEQ ID NO: 2148 - DNA, 24 bp, Artificial Sequence
  Description of Artificial Sequence: Synthetic oligonucleotide
ggcggactcagtactgagtccgcc

SEQ ID NO: 2149 - DNA, 24 bp, Artificial Sequence
  Description of Artificial Sequence: Synthetic oligonucleotide
agcggactcagtactgagtccgct

SEQ ID NO: 2150 - DNA, 24 bp, Artificial Sequence
  Description of Artificial Sequence: Synthetic oligonucleotide
gacggactcagtactgagtccgtc

SEQ ID NO: 2151 - DNA, 24 bp, Artificial Sequence
  Description of Artificial Sequence: Synthetic oligonucleotide
ggaggactcagtactgagtcctcc

SEQ ID NO: 2152 - DNA, 24 bp, Artificial Sequence
  Description of Artificial Sequence: Synthetic oligonucleotide
ggcagactcagtactgagtctgcc

SEQ ID NO: 2153 - DNA, 24 bp, Artificial Sequence
  Description of Artificial Sequence: Synthetic oligonucleotide
tgcggactcagtactgagtccgca

SEQ ID NO: 2154 - DNA, 24 bp, Artificial Sequence
  Description of Artificial Sequence: Synthetic oligonucleotide
gtcggactcagtactgagtccgac

SEQ ID NO: 2155 - DNA, 24 bp, Artificial Sequence
  Description of Artificial Sequence: Synthetic oligonucleotide
ggtggactcagtactgagtccacc

SEQ ID NO: 2156 - DNA, 24 bp, Artificial Sequence
  Description of Artificial Sequence: Synthetic oligonucleotide
ggctgactcagtactgagtcagcc

SEQ ID NO: 2157 - DNA, 24 bp, Artificial Sequence
  Description of Artificial Sequence: Synthetic oligonucleotide
gcccgactcagtactgagtcgggc

SEQ ID NO: 2158 - DNA, 24 bp, Artificial Sequence
  Description of Artificial Sequence: Synthetic oligonucleotide
acccgactcagtactgagtcgggt

SEQ ID NO: 2159 - DNA, 24 bp, Artificial Sequence
  Description of Artificial Sequence: Synthetic oligonucleotide
gaccgactcagtactgagtcggtc

SEQ ID NO: 2160 - DNA, 24 bp, Artificial Sequence
  Description of Artificial Sequence: Synthetic oligonucleotide
gcacgactcagtactgagtcgtgc

SEQ ID NO: 2161 - DNA, 24 bp, Artificial Sequence
  Description of Artificial Sequence: Synthetic oligonucleotide
gccagactcagtactgagtctggc

SEQ ID NO: 2162 - DNA, 24 bp, Artificial Sequence
  Description of Artificial Sequence: Synthetic oligonucleotide
tcccgactcagtactgagtcggga

SEQ ID NO: 2163 - DNA, 24 bp, Artificial Sequence
  Description of Artificial Sequence: Synthetic oligonucleotide
gtccgactcagtactgagtcggac

SEQ ID NO: 2164 - DNA, 24 bp, Artificial Sequence
  Description of Artificial Sequence: Synthetic oligonucleotide
gcctgactcagtactgagtcaggc

SEQ ID NO: 2165 - DNA, 24 bp, Artificial Sequence
  Description of Artificial Sequence: Synthetic oligonucleotide
gggcgactcagtactgagtcgccc

SEQ ID NO: 2166 - DNA, 24 bp, Artificial Sequence
  Description of Artificial Sequence: Synthetic oligonucleotide
aggcgactcagtactgagtcgcct

SEQ ID NO: 2167 - DNA, 24 bp, Artificial Sequence
  Description of Artificial Sequence: Synthetic oligonucleotide
gagcgactcagtactgagtcgctc

SEQ ID NO: 2168 - DNA, 24 bp, Artificial Sequence
  Description of Artificial Sequence: Synthetic oligonucleotide
ggacgactcagtactgagtcgtcc

SEQ ID NO: 2169 - DNA, 24 bp, Artificial Sequence
  Description of Artificial Sequence: Synthetic oligonucleotide
gggagactcagtactgagtctccc

SEQ ID NO: 2170 - DNA, 24 bp, Artificial Sequence
  Description of Artificial Sequence: Synthetic oligonucleotide
tggcgactcagtactgagtcgcca

SEQ ID NO: 2171 - DNA, 24 bp, Artificial Sequence
  Description of Artificial Sequence: Synthetic oligonucleotide
gtgcgactcagtactgagtcgcac

SEQ ID NO: 2172 - DNA, 24 bp, Artificial Sequence
  Description of Artificial Sequence: Synthetic oligonucleotide
gggtgactcagtactgagtcaccc

SEQ ID NO: 2173 - DNA, 24 bp, Artificial Sequence
  Description of Artificial Sequence: Synthetic oligonucleotide
acgggactcagtactgagtcccgt

SEQ ID NO: 2174 - DNA, 24 bp, Artificial Sequence
  Description of Artificial Sequence: Synthetic oligonucleotide
cagggactcagtactgagtccctg

SEQ ID NO: 2175 - DNA, 24 bp, Artificial Sequence
  Description of Artificial Sequence: Synthetic oligonucleotide
ccaggactcagtactgagtcctgg

SEQ ID NO: 2176 - DNA, 24 bp, Artificial Sequence
  Description of Artificial Sequence: Synthetic oligonucleotide
ccgagactcagtactgagtctcgg

SEQ ID NO: 2177 - DNA, 24 bp, Artificial Sequence
  Description of Artificial Sequence: Synthetic oligonucleotide
tcgggactcagtactgagtcccga

SEQ ID NO: 2178 - DNA, 24 bp, Artificial Sequence
  Description of Artificial Sequence: Synthetic oligonucleotide
ctgggactcagtactgagtcccag

SEQ ID NO: 2179 - DNA, 24 bp, Artificial Sequence
  Description of Artificial Sequence: Synthetic oligonucleotide
cctggactcagtactgagtccagg

SEQ ID NO: 2180 - DNA, 24 bp, Artificial Sequence
  Description of Artificial Sequence: Synthetic oligonucleotide
ccgtgactcagtactgagtcacgg

SEQ ID NO: 2181 - DNA, 24 bp, Artificial Sequence
  Description of Artificial Sequence: Synthetic oligonucleotide
cggcgactcagtactgagtcgccg

SEQ ID NO: 2182 - DNA, 24 bp, Artificial Sequence
  Description of Artificial Sequence: Synthetic oligonucleotide
cagcgactcagtactgagtcgctg

SEQ ID NO: 2183 - DNA, 24 bp, Artificial Sequence
  Description of Artificial Sequence: Synthetic oligonucleotide
cgacgactcagtactgagtcgtcg

SEQ ID NO: 2184 - DNA, 24 bp, Artificial Sequence
  Description of Artificial Sequence: Synthetic oligonucleotide
cggagactcagtactgagtctccg

SEQ ID NO: 2185 - DNA, 24 bp, Artificial Sequence
  Description of Artificial Sequence: Synthetic oligonucleotide
ctgcgactcagtactgagtcgcag

SEQ ID NO: 2186 - DNA, 24 bp, Artificial Sequence
  Description of Artificial Sequence: Synthetic oligonucleotide
cggtgactcagtactgagtcaccg

SEQ ID NO: 2187 - DNA, 24 bp, Artificial Sequence
  Description of Artificial Sequence: Synthetic oligonucleotide
cacggactcagtactgagtccgtg

SEQ ID NO: 2188 - DNA, 24 bp, Artificial Sequence
  Description of Artificial Sequence: Synthetic oligonucleotide
cccagactcagtactgagtctggg

SEQ ID NO: 2189 - DNA, 24 bp, Artificial Sequence
  Description of Artificial Sequence: Synthetic oligonucleotide
ctcggactcagtactgagtccgag

SEQ ID NO: 2190 - DNA, 24 bp, Artificial Sequence
  Description of Artificial Sequence: Synthetic oligonucleotide
ccctgactcagtactgagtcaggg

SEQ ID NO: 2191 - DNA, 24 bp, Artificial Sequence
  Description of Artificial Sequence: Synthetic oligonucleotide
ccacgactcagtactgagtcgtgg

SEQ ID NO: 2192 - DNA, 24 bp, Artificial Sequence
  Description of Artificial Sequence: Synthetic oligonucleotide
agccgactcagtactgagtcggct

SEQ ID NO: 2193 - DNA, 24 bp, Artificial Sequence
  Description of Artificial Sequence: Synthetic oligonucleotide
tgccgactcagtactgagtcggca

SEQ ID NO: 2194 - DNA, 24 bp, Artificial Sequence
  Description of Artificial Sequence: Synthetic oligonucleotide
gcgagactcagtactgagtctcgc

SEQ ID NO: 2195 - DNA, 24 bp, Artificial Sequence
  Description of Artificial Sequence: Synthetic oligonucleotide
gcgtgactcagtactgagtcacgc

SEQ ID NO: 2196 - DNA, 24 bp, Artificial Sequence
  Description of Artificial Sequence: Synthetic oligonucleotide
gcaggactcagtactgagtcctgc

SEQ ID NO: 2197 - DNA, 24 bp, Artificial Sequence
  Description of Artificial Sequence: Synthetic oligonucleotide
gctggactcagtactgagtccagc

SEQ ID NO: 2198 - DNA, 24 bp, Artificial Sequence
  Description of Artificial Sequence: Synthetic oligonucleotide
cgaggactcagtactgagtcctcg

SEQ ID NO: 2199 - DNA, 24 bp, Artificial Sequence
  Description of Artificial Sequence: Synthetic oligonucleotide
cgtggactcagtactgagtccacg

SEQ ID NO: 2200 - DNA, 24 bp, Artificial Sequence
  Description of Artificial Sequence: Synthetic oligonucleotide
caccgactcagtactgagtcggtg

SEQ ID NO: 2201 - DNA, 24 bp, Artificial Sequence
  Description of Artificial Sequence: Synthetic oligonucleotide
ctccgactcagtactgagtcggag

SEQ ID NO: 2202 - DNA, 24 bp, Artificial Sequence
  Description of Artificial Sequence: Synthetic oligonucleotide
gcgggactcagtactgagtcccgc

SEQ ID NO: 2203 - DNA, 24 bp, Artificial Sequence
  Description of Artificial Sequence: Synthetic oligonucleotide
gagggactcagtactgagtccctc

SEQ ID NO: 2204 - DNA, 24 bp, Artificial Sequence
  Description of Artificial Sequence: Synthetic oligonucleotide
gtgggactcagtactgagtcccac

SEQ ID NO: 2205 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaggcctgagtcnnnn

SEQ ID NO: 2206 - DNA, 24 bp, Artificial Sequence
  Description of Artificial Sequence: Synthetic oligonucleotide
ggcggactcaggcctgagtccgcc

SEQ ID NO: 2207 - DNA, 24 bp, Artificial Sequence
  Description of Artificial Sequence: Synthetic oligonucleotide
agcggactcaggcctgagtccgct

SEQ ID NO: 2208 - DNA, 24 bp, Artificial Sequence
  Description of Artificial Sequence: Synthetic oligonucleotide
gacggactcaggcctgagtccgtc

SEQ ID NO: 2209 - DNA, 24 bp, Artificial Sequence
  Description of Artificial Sequence: Synthetic oligonucleotide
ggaggactcaggcctgagtcctcc

SEQ ID NO: 2210 - DNA, 24 bp, Artificial Sequence
  Description of Artificial Sequence: Synthetic oligonucleotide
ggcagactcaggcctgagtctgcc

SEQ ID NO: 2211 - DNA, 24 bp, Artificial Sequence
  Description of Artificial Sequence: Synthetic oligonucleotide
tgcggactcaggcctgagtccgca

SEQ ID NO: 2212 - DNA, 24 bp, Artificial Sequence
  Description of Artificial Sequence: Synthetic oligonucleotide
gtcggactcaggcctgagtccgac

SEQ ID NO: 2213 - DNA, 24 bp, Artificial Sequence
  Description of Artificial Sequence: Synthetic oligonucleotide
ggtggactcaggcctgagtccacc

SEQ ID NO: 2214 - DNA, 24 bp, Artificial Sequence
  Description of Artificial Sequence: Synthetic oligonucleotide
ggctgactcaggcctgagtcagcc

SEQ ID NO: 2215 - DNA, 24 bp, Artificial Sequence
  Description of Artificial Sequence: Synthetic oligonucleotide
gcccgactcaggcctgagtcgggc

SEQ ID NO: 2216 - DNA, 24 bp, Artificial Sequence
  Description of Artificial Sequence: Synthetic oligonucleotide
acccgactcaggcctgagtcgggt

SEQ ID NO: 2217 - DNA, 24 bp, Artificial Sequence
  Description of Artificial Sequence: Synthetic oligonucleotide
gaccgactcaggcctgagtcggtc

SEQ ID NO: 2218 - DNA, 24 bp, Artificial Sequence
  Description of Artificial Sequence: Synthetic oligonucleotide
gcacgactcaggcctgagtcgtgc

SEQ ID NO: 2219 - DNA, 24 bp, Artificial Sequence
  Description of Artificial Sequence: Synthetic oligonucleotide
gccagactcaggcctgagtctggc

SEQ ID NO: 2220 - DNA, 24 bp, Artificial Sequence
  Description of Artificial Sequence: Synthetic oligonucleotide
tcccgactcaggcctgagtcggga

SEQ ID NO: 2221 - DNA, 24 bp, Artificial Sequence
  Description of Artificial Sequence: Synthetic oligonucleotide
gtccgactcaggcctgagtcggac

SEQ ID NO: 2222 - DNA, 24 bp, Artificial Sequence
  Description of Artificial Sequence: Synthetic oligonucleotide
gcctgactcaggcctgagtcaggc

SEQ ID NO: 2223 - DNA, 24 bp, Artificial Sequence
  Description of Artificial Sequence: Synthetic oligonucleotide
gggcgactcaggcctgagtcgccc

SEQ ID NO: 2224 - DNA, 24 bp, Artificial Sequence
  Description of Artificial Sequence: Synthetic oligonucleotide
aggcgactcaggcctgagtcgcct

SEQ ID NO: 2225 - DNA, 24 bp, Artificial Sequence
  Description of Artificial Sequence: Synthetic oligonucleotide
gagcgactcaggcctgagtcgctc

SEQ ID NO: 2226 - DNA, 24 bp, Artificial Sequence
  Description of Artificial Sequence: Synthetic oligonucleotide
ggacgactcaggcctgagtcgtcc

SEQ ID NO: 2227 - DNA, 24 bp, Artificial Sequence
  Description of Artificial Sequence: Synthetic oligonucleotide
gggagactcaggcctgagtctccc

SEQ ID NO: 2228 - DNA, 24 bp, Artificial Sequence
  Description of Artificial Sequence: Synthetic oligonucleotide
tggcgactcaggcctgagtcgcca

SEQ ID NO: 2229 - DNA, 24 bp, Artificial Sequence
  Description of Artificial Sequence: Synthetic oligonucleotide
gtgcgactcaggcctgagtcgcac

SEQ ID NO: 2230 - DNA, 24 bp, Artificial Sequence
  Description of Artificial Sequence: Synthetic oligonucleotide
gggtgactcaggcctgagtcaccc

SEQ ID NO: 2231 - DNA, 24 bp, Artificial Sequence
  Description of Artificial Sequence: Synthetic oligonucleotide
acgggactcaggcctgagtcccgt

SEQ ID NO: 2232 - DNA, 24 bp, Artificial Sequence
  Description of Artificial Sequence: Synthetic oligonucleotide
cagggactcaggcctgagtccctg

SEQ ID NO: 2233 - DNA, 24 bp, Artificial Sequence
  Description of Artificial Sequence: Synthetic oligonucleotide
ccaggactcaggcctgagtcctgg

SEQ ID NO: 2234 - DNA, 24 bp, Artificial Sequence
  Description of Artificial Sequence: Synthetic oligonucleotide
ccgagactcaggcctgagtctcgg

SEQ ID NO: 2235 - DNA, 24 bp, Artificial Sequence
  Description of Artificial Sequence: Synthetic oligonucleotide
tcgggactcaggcctgagtcccga

SEQ ID NO: 2236 - DNA, 24 bp, Artificial Sequence
  Description of Artificial Sequence: Synthetic oligonucleotide
ctgggactcaggcctgagtcccag

SEQ ID NO: 2237 - DNA, 24 bp, Artificial Sequence
  Description of Artificial Sequence: Synthetic oligonucleotide
cctggactcaggcctgagtccagg

SEQ ID NO: 2238 - DNA, 24 bp, Artificial Sequence
  Description of Artificial Sequence: Synthetic oligonucleotide
ccgtgactcaggcctgagtcacgg

SEQ ID NO: 2239 - DNA, 24 bp, Artificial Sequence
  Description of Artificial Sequence: Synthetic oligonucleotide
cggcgactcaggcctgagtcgccg

SEQ ID NO: 2240 - DNA, 24 bp, Artificial Sequence
  Description of Artificial Sequence: Synthetic oligonucleotide
cagcgactcaggcctgagtcgctg

SEQ ID NO: 2241 - DNA, 24 bp, Artificial Sequence
  Description of Artificial Sequence: Synthetic oligonucleotide
cgacgactcaggcctgagtcgtcg

SEQ ID NO: 2242 - DNA, 24 bp, Artificial Sequence
  Description of Artificial Sequence: Synthetic oligonucleotide
cggagactcaggcctgagtctccg

SEQ ID NO: 2243 - DNA, 24 bp, Artificial Sequence
  Description of Artificial Sequence: Synthetic oligonucleotide
ctgcgactcaggcctgagtcgcag

SEQ ID NO: 2244 - DNA, 24 bp, Artificial Sequence
  Description of Artificial Sequence: Synthetic oligonucleotide
cggtgactcaggcctgagtcaccg

SEQ ID NO: 2245 - DNA, 24 bp, Artificial Sequence
  Description of Artificial Sequence: Synthetic oligonucleotide
cacggactcaggcctgagtccgtg

SEQ ID NO: 2246 - DNA, 24 bp, Artificial Sequence
  Description of Artificial Sequence: Synthetic oligonucleotide
cccagactcaggcctgagtctggg

SEQ ID NO: 2247 - DNA, 24 bp, Artificial Sequence
  Description of Artificial Sequence: Synthetic oligonucleotide
ctcggactcaggcctgagtccgag

SEQ ID NO: 2248 - DNA, 24 bp, Artificial Sequence
  Description of Artificial Sequence: Synthetic oligonucleotide
ccctgactcaggcctgagtcaggg

SEQ ID NO: 2249 - DNA, 24 bp, Artificial Sequence
  Description of Artificial Sequence: Synthetic oligonucleotide
ccacgactcaggcctgagtcgtgg

SEQ ID NO: 2250 - DNA, 24 bp, Artificial Sequence
  Description of Artificial Sequence: Synthetic oligonucleotide
agccgactcaggcctgagtcggct

SEQ ID NO: 2251 - DNA, 24 bp, Artificial Sequence
  Description of Artificial Sequence: Synthetic oligonucleotide
tgccgactcaggcctgagtcggca

SEQ ID NO: 2252 - DNA, 24 bp, Artificial Sequence
  Description of Artificial Sequence: Synthetic oligonucleotide
gcgagactcaggcctgagtctcgc

SEQ ID NO: 2253 - DNA, 24 bp, Artificial Sequence
  Description of Artificial Sequence: Synthetic oligonucleotide
gcgtgactcaggcctgagtcacgc

SEQ ID NO: 2254 - DNA, 24 bp, Artificial Sequence
  Description of Artificial Sequence: Synthetic oligonucleotide
gcaggactcaggcctgagtcctgc

SEQ ID NO: 2255 - DNA, 24 bp, Artificial Sequence
  Description of Artificial Sequence: Synthetic oligonucleotide
gctggactcaggcctgagtccagc

SEQ ID NO: 2256 - DNA, 24 bp, Artificial Sequence
  Description of Artificial Sequence: Synthetic oligonucleotide
cgaggactcaggcctgagtcctcg

SEQ ID NO: 2257 - DNA, 24 bp, Artificial Sequence
  Description of Artificial Sequence: Synthetic oligonucleotide
cgtggactcaggcctgagtccacg

SEQ ID NO: 2258 - DNA, 24 bp, Artificial Sequence
  Description of Artificial Sequence: Synthetic oligonucleotide
caccgactcaggcctgagtcggtg

SEQ ID NO: 2259 - DNA, 24 bp, Artificial Sequence
  Description of Artificial Sequence: Synthetic oligonucleotide
ctccgactcaggcctgagtcggag

SEQ ID NO: 2260 - DNA, 24 bp, Artificial Sequence
  Description of Artificial Sequence: Synthetic oligonucleotide
gcgggactcaggcctgagtcccgc

SEQ ID NO: 2261 - DNA, 24 bp, Artificial Sequence
  Description of Artificial Sequence: Synthetic oligonucleotide
gagggactcaggcctgagtccctc

SEQ ID NO: 2262 - DNA, 24 bp, Artificial Sequence
  Description of Artificial Sequence: Synthetic oligonucleotide
gtgggactcaggcctgagtcccac

SEQ ID NO: 2263 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcagcgctgagtcnnnn

SEQ ID NO: 2264 - DNA, 24 bp, Artificial Sequence
  Description of Artificial Sequence: Synthetic oligonucleotide
ggcggactcagcgctgagtccgcc

SEQ ID NO: 2265 - DNA, 24 bp, Artificial Sequence
  Description of Artificial Sequence: Synthetic oligonucleotide
agcggactcagcgctgagtccgct

SEQ ID NO: 2266 - DNA, 24 bp, Artificial Sequence
  Description of Artificial Sequence: Synthetic oligonucleotide
gacggactcagcgctgagtccgtc

SEQ ID NO: 2267 - DNA, 24 bp, Artificial Sequence
  Description of Artificial Sequence: Synthetic oligonucleotide
ggaggactcagcgctgagtcctcc

SEQ ID NO: 2268 - DNA, 24 bp, Artificial Sequence
  Description of Artificial Sequence: Synthetic oligonucleotide
ggcagactcagcgctgagtctgcc

SEQ ID NO: 2269 - DNA, 24 bp, Artificial Sequence
  Description of Artificial Sequence: Synthetic oligonucleotide
tgcggactcagcgctgagtccgca

SEQ ID NO: 2270 - DNA, 24 bp, Artificial Sequence
  Description of Artificial Sequence: Synthetic oligonucleotide
gtcggactcagcgctgagtccgac

SEQ ID NO: 2271 - DNA, 24 bp, Artificial Sequence
  Description of Artificial Sequence: Synthetic oligonucleotide
ggtggactcagcgctgagtccacc

SEQ ID NO: 2272 - DNA, 24 bp, Artificial Sequence
  Description of Artificial Sequence: Synthetic oligonucleotide
ggctgactcagcgctgagtcagcc

SEQ ID NO: 2273 - DNA, 24 bp, Artificial Sequence
  Description of Artificial Sequence: Synthetic oligonucleotide
gcccgactcagcgctgagtcgggc

SEQ ID NO: 2274 - DNA, 24 bp, Artificial Sequence
  Description of Artificial Sequence: Synthetic oligonucleotide
acccgactcagcgctgagtcgggt

SEQ ID NO: 2275 - DNA, 24 bp, Artificial Sequence
  Description of Artificial Sequence: Synthetic oligonucleotide
gaccgactcagcgctgagtcggtc

SEQ ID NO: 2276 - DNA, 24 bp, Artificial Sequence
  Description of Artificial Sequence: Synthetic oligonucleotide
gcacgactcagcgctgagtcgtgc

SEQ ID NO: 2277 - DNA, 24 bp, Artificial Sequence
  Description of Artificial Sequence: Synthetic oligonucleotide
gccagactcagcgctgagtctggc

SEQ ID NO: 2278 - DNA, 24 bp, Artificial Sequence
  Description of Artificial Sequence: Synthetic oligonucleotide
tcccgactcagcgctgagtcggga

SEQ ID NO: 2279 - DNA, 24 bp, Artificial Sequence
  Description of Artificial Sequence: Synthetic oligonucleotide
gtccgactcagcgctgagtcggac

SEQ ID NO: 2280 - DNA, 24 bp, Artificial Sequence
  Description of Artificial Sequence: Synthetic oligonucleotide
gcctgactcagcgctgagtcaggc

SEQ ID NO: 2281 - DNA, 24 bp, Artificial Sequence
  Description of Artificial Sequence: Synthetic oligonucleotide
gggcgactcagcgctgagtcgccc

SEQ ID NO: 2282 - DNA, 24 bp, Artificial Sequence
  Description of Artificial Sequence: Synthetic oligonucleotide
aggcgactcagcgctgagtcgcct

SEQ ID NO: 2283 - DNA, 24 bp, Artificial Sequence
  Description of Artificial Sequence: Synthetic oligonucleotide
gagcgactcagcgctgagtcgctc

SEQ ID NO: 2284 - DNA, 24 bp, Artificial Sequence
  Description of Artificial Sequence: Synthetic oligonucleotide
ggacgactcagcgctgagtcgtcc

SEQ ID NO: 2285 - DNA, 24 bp, Artificial Sequence
  Description of Artificial Sequence: Synthetic oligonucleotide
gggagactcagcgctgagtctccc

SEQ ID NO: 2286 - DNA, 24 bp, Artificial Sequence
  Description of Artificial Sequence: Synthetic oligonucleotide
tggcgactcagcgctgagtcgcca

SEQ ID NO: 2287 - DNA, 24 bp, Artificial Sequence
  Description of Artificial Sequence: Synthetic oligonucleotide
gtgcgactcagcgctgagtcgcac

SEQ ID NO: 2288 - DNA, 24 bp, Artificial Sequence
  Description of Artificial Sequence: Synthetic oligonucleotide
gggtgactcagcgctgagtcaccc

SEQ ID NO: 2289 - DNA, 24 bp, Artificial Sequence
  Description of Artificial Sequence: Synthetic oligonucleotide
acgggactcagcgctgagtcccgt

SEQ ID NO: 2290 - DNA, 24 bp, Artificial Sequence
  Description of Artificial Sequence: Synthetic oligonucleotide
cagggactcagcgctgagtccctg

SEQ ID NO: 2291 - DNA, 24 bp, Artificial Sequence
  Description of Artificial Sequence: Synthetic oligonucleotide
ccaggactcagcgctgagtcctgg

SEQ ID NO: 2292 - DNA, 24 bp, Artificial Sequence
  Description of Artificial Sequence: Synthetic oligonucleotide
ccgagactcagcgctgagtctcgg

SEQ ID NO: 2293 - DNA, 24 bp, Artificial Sequence
  Description of Artificial Sequence: Synthetic oligonucleotide
tcgggactcagcgctgagtcccga

SEQ ID NO: 2294 - DNA, 24 bp, Artificial Sequence
  Description of Artificial Sequence: Synthetic oligonucleotide
ctgggactcagcgctgagtcccag

SEQ ID NO: 2295 - DNA, 24 bp, Artificial Sequence
  Description of Artificial Sequence: Synthetic oligonucleotide
cctggactcagcgctgagtccagg

SEQ ID NO: 2296 - DNA, 24 bp, Artificial Sequence
  Description of Artificial Sequence: Synthetic oligonucleotide
ccgtgactcagcgctgagtcacgg

SEQ ID NO: 2297 - DNA, 24 bp, Artificial Sequence
  Description of Artificial Sequence: Synthetic oligonucleotide
cggcgactcagcgctgagtcgccg

SEQ ID NO: 2298 - DNA, 24 bp, Artificial Sequence
  Description of Artificial Sequence: Synthetic oligonucleotide
cagcgactcagcgctgagtcgctg

SEQ ID NO: 2299 - DNA, 24 bp, Artificial Sequence
  Description of Artificial Sequence: Synthetic oligonucleotide
cgacgactcagcgctgagtcgtcg

SEQ ID NO: 2300 - DNA, 24 bp, Artificial Sequence
  Description of Artificial Sequence: Synthetic oligonucleotide
cggagactcagcgctgagtctccg

SEQ ID NO: 2301 - DNA, 24 bp, Artificial Sequence
  Description of Artificial Sequence: Synthetic oligonucleotide
ctgcgactcagcgctgagtcgcag

SEQ ID NO: 2302 - DNA, 24 bp, Artificial Sequence
  Description of Artificial Sequence: Synthetic oligonucleotide
cggtgactcagcgctgagtcaccg

SEQ ID NO: 2303 - DNA, 24 bp, Artificial Sequence
  Description of Artificial Sequence: Synthetic oligonucleotide
cacggactcagcgctgagtccgtg

SEQ ID NO: 2304 - DNA, 24 bp, Artificial Sequence
  Description of Artificial Sequence: Synthetic oligonucleotide
cccagactcagcgctgagtctggg

SEQ ID NO: 2305 - DNA, 24 bp, Artificial Sequence
  Description of Artificial Sequence: Synthetic oligonucleotide
ctcggactcagcgctgagtccgag

SEQ ID NO: 2306 - DNA, 24 bp, Artificial Sequence
  Description of Artificial Sequence: Synthetic oligonucleotide
ccctgactcagcgctgagtcaggg

SEQ ID NO: 2307 - DNA, 24 bp, Artificial Sequence
  Description of Artificial Sequence: Synthetic oligonucleotide
ccacgactcagcgctgagtcgtgg

SEQ ID NO: 2308 - DNA, 24 bp, Artificial Sequence
  Description of Artificial Sequence: Synthetic oligonucleotide
agccgactcagcgctgagtcggct

SEQ ID NO: 2309 - DNA, 24 bp, Artificial Sequence
  Description of Artificial Sequence: Synthetic oligonucleotide
tgccgactcagcgctgagtcggca

SEQ ID NO: 2310 - DNA, 24 bp, Artificial Sequence
  Description of Artificial Sequence: Synthetic oligonucleotide
gcgagactcagcgctgagtctcgc

SEQ ID NO: 2311 - DNA, 24 bp, Artificial Sequence
  Description of Artificial Sequence: Synthetic oligonucleotide
gcgtgactcagcgctgagtcacgc

SEQ ID NO: 2312 - DNA, 24 bp, Artificial Sequence
  Description of Artificial Sequence: Synthetic oligonucleotide
gcaggactcagcgctgagtcctgc

SEQ ID NO: 2313 - DNA, 24 bp, Artificial Sequence
  Description of Artificial Sequence: Synthetic oligonucleotide
gctggactcagcgctgagtccagc

SEQ ID NO: 2314 - DNA, 24 bp, Artificial Sequence
  Description of Artificial Sequence: Synthetic oligonucleotide
cgaggactcagcgctgagtcctcg

SEQ ID NO: 2315 - DNA, 24 bp, Artificial Sequence
  Description of Artificial Sequence: Synthetic oligonucleotide
cgtggactcagcgctgagtccacg

SEQ ID NO: 2316 - DNA, 24 bp, Artificial Sequence
  Description of Artificial Sequence: Synthetic oligonucleotide
caccgactcagcgctgagtcggtg

SEQ ID NO: 2317 - DNA, 24 bp, Artificial Sequence
  Description of Artificial Sequence: Synthetic oligonucleotide
ctccgactcagcgctgagtcggag

SEQ ID NO: 2318 - DNA, 24 bp, Artificial Sequence
  Description of Artificial Sequence: Synthetic oligonucleotide
gcgggactcagcgctgagtcccgc

SEQ ID NO: 2319 - DNA, 24 bp, Artificial Sequence
  Description of Artificial Sequence: Synthetic oligonucleotide
gagggactcagcgctgagtccctc

SEQ ID NO: 2320 - DNA, 24 bp, Artificial Sequence
  Description of Artificial Sequence: Synthetic oligonucleotide
gtgggactcagcgctgagtcccac

SEQ ID NO: 2321 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaaatttgagtcnnnn

SEQ ID NO: 2322 - DNA, 24 bp, Artificial Sequence
  Description of Artificial Sequence: Synthetic oligonucleotide
ggcggactcaaatttgagtccgcc

SEQ ID NO: 2323 - DNA, 24 bp, Artificial Sequence
  Description of Artificial Sequence: Synthetic oligonucleotide
agcggactcaaatttgagtccgct

SEQ ID NO: 2324 - DNA, 24 bp, Artificial Sequence
  Description of Artificial Sequence: Synthetic oligonucleotide
gacggactcaaatttgagtccgtc

SEQ ID NO: 2325 - DNA, 24 bp, Artificial Sequence
  Description of Artificial Sequence: Synthetic oligonucleotide
ggaggactcaaatttgagtcctcc

SEQ ID NO: 2326 - DNA, 24 bp, Artificial Sequence
  Description of Artificial Sequence: Synthetic oligonucleotide
ggcagactcaaatttgagtctgcc

SEQ ID NO: 2327 - DNA, 24 bp, Artificial Sequence
  Description of Artificial Sequence: Synthetic oligonucleotide
tgcggactcaaatttgagtccgca

SEQ ID NO: 2328 - DNA, 24 bp, Artificial Sequence
  Description of Artificial Sequence: Synthetic oligonucleotide
gtcggactcaaatttgagtccgac

SEQ ID NO: 2329 - DNA, 24 bp, Artificial Sequence
  Description of Artificial Sequence: Synthetic oligonucleotide
ggtggactcaaatttgagtccacc

SEQ ID NO: 2330 - DNA, 24 bp, Artificial Sequence
  Description of Artificial Sequence: Synthetic oligonucleotide
ggctgactcaaatttgagtcagcc

SEQ ID NO: 2331 - DNA, 24 bp, Artificial Sequence
  Description of Artificial Sequence: Synthetic oligonucleotide
gcccgactcaaatttgagtcgggc

SEQ ID NO: 2332 - DNA, 24 bp, Artificial Sequence
  Description of Artificial Sequence: Synthetic oligonucleotide
acccgactcaaatttgagtcgggt

SEQ ID NO: 2333 - DNA, 24 bp, Artificial Sequence
  Description of Artificial Sequence: Synthetic oligonucleotide
gaccgactcaaatttgagtcggtc

SEQ ID NO: 2334 - DNA, 24 bp, Artificial Sequence
  Description of Artificial Sequence: Synthetic oligonucleotide
gcacgactcaaatttgagtcgtgc

SEQ ID NO: 2335 - DNA, 24 bp, Artificial Sequence
  Description of Artificial Sequence: Synthetic oligonucleotide
gccagactcaaatttgagtctggc

SEQ ID NO: 2336 - DNA, 24 bp, Artificial Sequence
  Description of Artificial Sequence: Synthetic oligonucleotide
tcccgactcaaatttgagtcggga

SEQ ID NO: 2337 - DNA, 24 bp, Artificial Sequence
  Description of Artificial Sequence: Synthetic oligonucleotide
gtccgactcaaatttgagtcggac

SEQ ID NO: 2338 - DNA, 24 bp, Artificial Sequence
  Description of Artificial Sequence: Synthetic oligonucleotide
gcctgactcaaatttgagtcaggc

SEQ ID NO: 2339 - DNA, 24 bp, Artificial Sequence
  Description of Artificial Sequence: Synthetic oligonucleotide
gggcgactcaaatttgagtcgccc

SEQ ID NO: 2340 - DNA, 24 bp, Artificial Sequence
  Description of Artificial Sequence: Synthetic oligonucleotide
aggcgactcaaatttgagtcgcct

SEQ ID NO: 2341 - DNA, 24 bp, Artificial Sequence
  Description of Artificial Sequence: Synthetic oligonucleotide
gagcgactcaaatttgagtcgctc

SEQ ID NO: 2342 - DNA, 24 bp, Artificial Sequence
  Description of Artificial Sequence: Synthetic oligonucleotide
ggacgactcaaatttgagtcgtcc

SEQ ID NO: 2343 - DNA, 24 bp, Artificial Sequence
  Description of Artificial Sequence: Synthetic oligonucleotide
gggagactcaaatttgagtctccc

SEQ ID NO: 2344 - DNA, 24 bp, Artificial Sequence
  Description of Artificial Sequence: Synthetic oligonucleotide
tggcgactcaaatttgagtcgcca

SEQ ID NO: 2345 - DNA, 24 bp, Artificial Sequence
  Description of Artificial Sequence: Synthetic oligonucleotide
gtgcgactcaaatttgagtcgcac

SEQ ID NO: 2346 - DNA, 24 bp, Artificial Sequence
  Description of Artificial Sequence: Synthetic oligonucleotide
gggtgactcaaatttgagtcaccc

SEQ ID NO: 2347 - DNA, 24 bp, Artificial Sequence
  Description of Artificial Sequence: Synthetic oligonucleotide
acgggactcaaatttgagtcccgt

SEQ ID NO: 2348 - DNA, 24 bp, Artificial Sequence
  Description of Artificial Sequence: Synthetic oligonucleotide
cagggactcaaatttgagtccctg

SEQ ID NO: 2349 - DNA, 24 bp, Artificial Sequence
  Description of Artificial Sequence: Synthetic oligonucleotide
ccaggactcaaatttgagtcctgg

SEQ ID NO: 2350 - DNA, 24 bp, Artificial Sequence
  Description of Artificial Sequence: Synthetic oligonucleotide
ccgagactcaaatttgagtctcgg

SEQ ID NO: 2351 - DNA, 24 bp, Artificial Sequence
  Description of Artificial Sequence: Synthetic oligonucleotide
tcgggactcaaatttgagtcccga

SEQ ID NO: 2352 - DNA, 24 bp, Artificial Sequence
  Description of Artificial Sequence: Synthetic oligonucleotide
ctgggactcaaatttgagtcccag

SEQ ID NO: 2353 - DNA, 24 bp, Artificial Sequence
  Description of Artificial Sequence: Synthetic oligonucleotide
cctggactcaaatttgagtccagg

SEQ ID NO: 2354 - DNA, 24 bp, Artificial Sequence
  Description of Artificial Sequence: Synthetic oligonucleotide
ccgtgactcaaatttgagtcacgg

SEQ ID NO: 2355 - DNA, 24 bp, Artificial Sequence
  Description of Artificial Sequence: Synthetic oligonucleotide
cggcgactcaaatttgagtcgccg

SEQ ID NO: 2356 - DNA, 24 bp, Artificial Sequence
  Description of Artificial Sequence: Synthetic oligonucleotide
cagcgactcaaatttgagtcgctg

SEQ ID NO: 2357 - DNA, 24 bp, Artificial Sequence
  Description of Artificial Sequence: Synthetic oligonucleotide
cgacgactcaaatttgagtcgtcg

SEQ ID NO: 2358 - DNA, 24 bp, Artificial Sequence
  Description of Artificial Sequence: Synthetic oligonucleotide
cggagactcaaatttgagtctccg

SEQ ID NO: 2359 - DNA, 24 bp, Artificial Sequence
  Description of Artificial Sequence: Synthetic oligonucleotide
ctgcgactcaaatttgagtcgcag

SEQ ID NO: 2360 - DNA, 24 bp, Artificial Sequence
  Description of Artificial Sequence: Synthetic oligonucleotide
cggtgactcaaatttgagtcaccg

SEQ ID NO: 2361 - DNA, 24 bp, Artificial Sequence
  Description of Artificial Sequence: Synthetic oligonucleotide
cacggactcaaatttgagtccgtg

SEQ ID NO: 2362 - DNA, 24 bp, Artificial Sequence
  Description of Artificial Sequence: Synthetic oligonucleotide
cccagactcaaatttgagtctggg

SEQ ID NO: 2363 - DNA, 24 bp, Artificial Sequence
  Description of Artificial Sequence: Synthetic oligonucleotide
ctcggactcaaatttgagtccgag

SEQ ID NO: 2364 - DNA, 24 bp, Artificial Sequence
  Description of Artificial Sequence: Synthetic oligonucleotide
ccctgactcaaatttgagtcaggg

SEQ ID NO: 2365 - DNA, 24 bp, Artificial Sequence
  Description of Artificial Sequence: Synthetic oligonucleotide
ccacgactcaaatttgagtcgtgg

SEQ ID NO: 2366 - DNA, 24 bp, Artificial Sequence
  Description of Artificial Sequence: Synthetic oligonucleotide
agccgactcaaatttgagtcggct

SEQ ID NO: 2367 - DNA, 24 bp, Artificial Sequence
  Description of Artificial Sequence: Synthetic oligonucleotide
tgccgactcaaatttgagtcggca

SEQ ID NO: 2368 - DNA, 24 bp, Artificial Sequence
  Description of Artificial Sequence: Synthetic oligonucleotide
gcgagactcaaatttgagtctcgc

SEQ ID NO: 2369 - DNA, 24 bp, Artificial Sequence
  Description of Artificial Sequence: Synthetic oligonucleotide
gcgtgactcaaatttgagtcacgc

SEQ ID NO: 2370 - DNA, 24 bp, Artificial Sequence
  Description of Artificial Sequence: Synthetic oligonucleotide
gcaggactcaaatttgagtcctgc

SEQ ID NO: 2371 - DNA, 24 bp, Artificial Sequence
  Description of Artificial Sequence: Synthetic oligonucleotide
gctggactcaaatttgagtccagc

SEQ ID NO: 2372 - DNA, 24 bp, Artificial Sequence
  Description of Artificial Sequence: Synthetic oligonucleotide
cgaggactcaaatttgagtcctcg

SEQ ID NO: 2373 - DNA, 24 bp, Artificial Sequence
  Description of Artificial Sequence: Synthetic oligonucleotide
cgtggactcaaatttgagtccacg

SEQ ID NO: 2374 - DNA, 24 bp, Artificial Sequence
  Description of Artificial Sequence: Synthetic oligonucleotide
caccgactcaaatttgagtcggtg

SEQ ID NO: 2375 - DNA, 24 bp, Artificial Sequence
  Description of Artificial Sequence: Synthetic oligonucleotide
ctccgactcaaatttgagtcggag

SEQ ID NO: 2376 - DNA, 24 bp, Artificial Sequence
  Description of Artificial Sequence: Synthetic oligonucleotide
gcgggactcaaatttgagtcccgc

SEQ ID NO: 2377 - DNA, 24 bp, Artificial Sequence
  Description of Artificial Sequence: Synthetic oligonucleotide
gagggactcaaatttgagtccctc

SEQ ID NO: 2378 - DNA, 24 bp, Artificial Sequence
  Description of Artificial Sequence: Synthetic oligonucleotide
gtgggactcaaatttgagtcccac

SEQ ID NO: 2379 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaatattgagtcnnnn

SEQ ID NO: 2380 - DNA, 24 bp, Artificial Sequence
  Description of Artificial Sequence: Synthetic oligonucleotide
ggcggactcaatattgagtccgcc

SEQ ID NO: 2381 - DNA, 24 bp, Artificial Sequence
  Description of Artificial Sequence: Synthetic oligonucleotide
agcggactcaatattgagtccgct

SEQ ID NO: 2382 - DNA, 24 bp, Artificial Sequence
  Description of Artificial Sequence: Synthetic oligonucleotide
gacggactcaatattgagtccgtc

SEQ ID NO: 2383 - DNA, 24 bp, Artificial Sequence
  Description of Artificial Sequence: Synthetic oligonucleotide
ggaggactcaatattgagtcctcc

SEQ ID NO: 2384 - DNA, 24 bp, Artificial Sequence
  Description of Artificial Sequence: Synthetic oligonucleotide
ggcagactcaatattgagtctgcc

SEQ ID NO: 2385 - DNA, 24 bp, Artificial Sequence
  Description of Artificial Sequence: Synthetic oligonucleotide
tgcggactcaatattgagtccgca

SEQ ID NO: 2386 - DNA, 24 bp, Artificial Sequence
  Description of Artificial Sequence: Synthetic oligonucleotide
gtcggactcaatattgagtccgac

SEQ ID NO: 2387 - DNA, 24 bp, Artificial Sequence
  Description of Artificial Sequence: Synthetic oligonucleotide
ggtggactcaatattgagtccacc

SEQ ID NO: 2388 - DNA, 24 bp, Artificial Sequence
  Description of Artificial Sequence: Synthetic oligonucleotide
ggctgactcaatattgagtcagcc

SEQ ID NO: 2389 - DNA, 24 bp, Artificial Sequence
  Description of Artificial Sequence: Synthetic oligonucleotide
gcccgactcaatattgagtcgggc

SEQ ID NO: 2390 - DNA, 24 bp, Artificial Sequence
  Description of Artificial Sequence: Synthetic oligonucleotide
acccgactcaatattgagtcgggt

SEQ ID NO: 2391 - DNA, 24 bp, Artificial Sequence
  Description of Artificial Sequence: Synthetic oligonucleotide
gaccgactcaatattgagtcggtc

SEQ ID NO: 2392 - DNA, 24 bp, Artificial Sequence
  Description of Artificial Sequence: Synthetic oligonucleotide
gcacgactcaatattgagtcgtgc

SEQ ID NO: 2393 - DNA, 24 bp, Artificial Sequence
  Description of Artificial Sequence: Synthetic oligonucleotide
gccagactcaatattgagtctggc

SEQ ID NO: 2394 - DNA, 24 bp, Artificial Sequence
  Description of Artificial Sequence: Synthetic oligonucleotide
tcccgactcaatattgagtcggga

SEQ ID NO: 2395 - DNA, 24 bp, Artificial Sequence
  Description of Artificial Sequence: Synthetic oligonucleotide
gtccgactcaatattgagtcggac

SEQ ID NO: 2396 - DNA, 24 bp, Artificial Sequence
  Description of Artificial Sequence: Synthetic oligonucleotide
gcctgactcaatattgagtcaggc

SEQ ID NO: 2397 - DNA, 24 bp, Artificial Sequence
  Description of Artificial Sequence: Synthetic oligonucleotide
gggcgactcaatattgagtcgccc

SEQ ID NO: 2398 - DNA, 24 bp, Artificial Sequence
  Description of Artificial Sequence: Synthetic oligonucleotide
aggcgactcaatattgagtcgcct

SEQ ID NO: 2399 - DNA, 24 bp, Artificial Sequence
  Description of Artificial Sequence: Synthetic oligonucleotide
gagcgactcaatattgagtcgctc

SEQ ID NO: 2400 - DNA, 24 bp, Artificial Sequence
  Description of Artificial Sequence: Synthetic oligonucleotide
ggacgactcaatattgagtcgtcc

SEQ ID NO: 2401 - DNA, 24 bp, Artificial Sequence
  Description of Artificial Sequence: Synthetic oligonucleotide
gggagactcaatattgagtctccc

SEQ ID NO: 2402 - DNA, 24 bp, Artificial Sequence
  Description of Artificial Sequence: Synthetic oligonucleotide
tggcgactcaatattgagtcgcca

SEQ ID NO: 2403 - DNA, 24 bp, Artificial Sequence
  Description of Artificial Sequence: Synthetic oligonucleotide
gtgcgactcaatattgagtcgcac

SEQ ID NO: 2404 - DNA, 24 bp, Artificial Sequence
  Description of Artificial Sequence: Synthetic oligonucleotide
gggtgactcaatattgagtcaccc

SEQ ID NO: 2405 - DNA, 24 bp, Artificial Sequence
  Description of Artificial Sequence: Synthetic oligonucleotide
acgggactcaatattgagtcccgt

SEQ ID NO: 2406 - DNA, 24 bp, Artificial Sequence
  Description of Artificial Sequence: Synthetic oligonucleotide
cagggactcaatattgagtccctg

SEQ ID NO: 2407 - DNA, 24 bp, Artificial Sequence
  Description of Artificial Sequence: Synthetic oligonucleotide
ccaggactcaatattgagtcctgg

SEQ ID NO: 2408 - DNA, 24 bp, Artificial Sequence
  Description of Artificial Sequence: Synthetic oligonucleotide
ccgagactcaatattgagtctcgg

SEQ ID NO: 2409 - DNA, 24 bp, Artificial Sequence
  Description of Artificial Sequence: Synthetic oligonucleotide
tcgggactcaatattgagtcccga

SEQ ID NO: 2410 - DNA, 24 bp, Artificial Sequence
  Description of Artificial Sequence: Synthetic oligonucleotide
ctgggactcaatattgagtcccag

SEQ ID NO: 2411 - DNA, 24 bp, Artificial Sequence
  Description of Artificial Sequence: Synthetic oligonucleotide
cctggactcaatattgagtccagg

SEQ ID NO: 2412 - DNA, 24 bp, Artificial Sequence
  Description of Artificial Sequence: Synthetic oligonucleotide
ccgtgactcaatattgagtcacgg

SEQ ID NO: 2413 - DNA, 24 bp, Artificial Sequence
  Description of Artificial Sequence: Synthetic oligonucleotide
cggcgactcaatattgagtcgccg

SEQ ID NO: 2414 - DNA, 24 bp, Artificial Sequence
  Description of Artificial Sequence: Synthetic oligonucleotide
cagcgactcaatattgagtcgctg

SEQ ID NO: 2415 - DNA, 24 bp, Artificial Sequence
  Description of Artificial Sequence: Synthetic oligonucleotide
cgacgactcaatattgagtcgtcg

SEQ ID NO: 2416 - DNA, 24 bp, Artificial Sequence
  Description of Artificial Sequence: Synthetic oligonucleotide
cggagactcaatattgagtctccg

SEQ ID NO: 2417 - DNA, 24 bp, Artificial Sequence
  Description of Artificial Sequence: Synthetic oligonucleotide
ctgcgactcaatattgagtcgcag

SEQ ID NO: 2418 - DNA, 24 bp, Artificial Sequence
  Description of Artificial Sequence: Synthetic oligonucleotide
cggtgactcaatattgagtcaccg

SEQ ID NO: 2419 - DNA, 24 bp, Artificial Sequence
  Description of Artificial Sequence: Synthetic oligonucleotide
cacggactcaatattgagtccgtg

SEQ ID NO: 2420 - DNA, 24 bp, Artificial Sequence
  Description of Artificial Sequence: Synthetic oligonucleotide
cccagactcaatattgagtctggg

SEQ ID NO: 2421 - DNA, 24 bp, Artificial Sequence
  Description of Artificial Sequence: Synthetic oligonucleotide
ctcggactcaatattgagtccgag

SEQ ID NO: 2422 - DNA, 24 bp, Artificial Sequence
  Description of Artificial Sequence: Synthetic oligonucleotide
ccctgactcaatattgagtcaggg

SEQ ID NO: 2423 - DNA, 24 bp, Artificial Sequence
  Description of Artificial Sequence: Synthetic oligonucleotide
ccacgactcaatattgagtcgtgg

SEQ ID NO: 2424 - DNA, 24 bp, Artificial Sequence
  Description of Artificial Sequence: Synthetic oligonucleotide
agccgactcaatattgagtcggct

SEQ ID NO: 2425 - DNA, 24 bp, Artificial Sequence
  Description of Artificial Sequence: Synthetic oligonucleotide
tgccgactcaatattgagtcggca

SEQ ID NO: 2426 - DNA, 24 bp, Artificial Sequence
  Description of Artificial Sequence: Synthetic oligonucleotide
gcgagactcaatattgagtctcgc

SEQ ID NO: 2427 - DNA, 24 bp, Artificial Sequence
  Description of Artificial Sequence: Synthetic oligonucleotide
gcgtgactcaatattgagtcacgc

SEQ ID NO: 2428 - DNA, 24 bp, Artificial Sequence
  Description of Artificial Sequence: Synthetic oligonucleotide
gcaggactcaatattgagtcctgc

SEQ ID NO: 2429 - DNA, 24 bp, Artificial Sequence
  Description of Artificial Sequence: Synthetic oligonucleotide
gctggactcaatattgagtccagc

SEQ ID NO: 2430 - DNA, 24 bp, Artificial Sequence
  Description of Artificial Sequence: Synthetic oligonucleotide
cgaggactcaatattgagtcctcg

SEQ ID NO: 2431 - DNA, 24 bp, Artificial Sequence
  Description of Artificial Sequence: Synthetic oligonucleotide
cgtggactcaatattgagtccacg

SEQ ID NO: 2432 - DNA, 24 bp, Artificial Sequence
  Description of Artificial Sequence: Synthetic oligonucleotide
caccgactcaatattgagtcggtg

SEQ ID NO: 2433 - DNA, 24 bp, Artificial Sequence
  Description of Artificial Sequence: Synthetic oligonucleotide
ctccgactcaatattgagtcggag

SEQ ID NO: 2434 - DNA, 24 bp, Artificial Sequence
  Description of Artificial Sequence: Synthetic oligonucleotide
gcgggactcaatattgagtcccgc

SEQ ID NO: 2435 - DNA, 24 bp, Artificial Sequence
  Description of Artificial Sequence: Synthetic oligonucleotide
gagggactcaatattgagtccctc

SEQ ID NO: 2436 - DNA, 24 bp, Artificial Sequence
  Description of Artificial Sequence: Synthetic oligonucleotide
gtgggactcaatattgagtcccac

SEQ ID NO: 2437 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaagcttgagtcnnnn

SEQ ID NO: 2438 - DNA, 24 bp, Artificial Sequence
  Description of Artificial Sequence: Synthetic oligonucleotide
ggcggactcaagcttgagtccgcc

SEQ ID NO: 2439 - DNA, 24 bp, Artificial Sequence
  Description of Artificial Sequence: Synthetic oligonucleotide
agcggactcaagcttgagtccgct

SEQ ID NO: 2440 - DNA, 24 bp, Artificial Sequence
  Description of Artificial Sequence: Synthetic oligonucleotide
gacggactcaagcttgagtccgtc

SEQ ID NO: 2441 - DNA, 24 bp, Artificial Sequence
  Description of Artificial Sequence: Synthetic oligonucleotide
ggaggactcaagcttgagtcctcc

SEQ ID NO: 2442 - DNA, 24 bp, Artificial Sequence
  Description of Artificial Sequence: Synthetic oligonucleotide
ggcagactcaagcttgagtctgcc

SEQ ID NO: 2443 - DNA, 24 bp, Artificial Sequence
  Description of Artificial Sequence: Synthetic oligonucleotide
tgcggactcaagcttgagtccgca

SEQ ID NO: 2444 - DNA, 24 bp, Artificial Sequence
  Description of Artificial Sequence: Synthetic oligonucleotide
gtcggactcaagcttgagtccgac

SEQ ID NO: 2445 - DNA, 24 bp, Artificial Sequence
  Description of Artificial Sequence: Synthetic oligonucleotide
ggtggactcaagcttgagtccacc

SEQ ID NO: 2446 - DNA, 24 bp, Artificial Sequence
  Description of Artificial Sequence: Synthetic oligonucleotide
ggctgactcaagcttgagtcagcc

SEQ ID NO: 2447 - DNA, 24 bp, Artificial Sequence
  Description of Artificial Sequence: Synthetic oligonucleotide
gcccgactcaagcttgagtcgggc

SEQ ID NO: 2448 - DNA, 24 bp, Artificial Sequence
  Description of Artificial Sequence: Synthetic oligonucleotide
acccgactcaagcttgagtcgggt

SEQ ID NO: 2449 - DNA, 24 bp, Artificial Sequence
  Description of Artificial Sequence: Synthetic oligonucleotide
gaccgactcaagcttgagtcggtc

SEQ ID NO: 2450 - DNA, 24 bp, Artificial Sequence
  Description of Artificial Sequence: Synthetic oligonucleotide
gcacgactcaagcttgagtcgtgc

SEQ ID NO: 2451 - DNA, 24 bp, Artificial Sequence
  Description of Artificial Sequence: Synthetic oligonucleotide
gccagactcaagcttgagtctggc

SEQ ID NO: 2452 - DNA, 24 bp, Artificial Sequence
  Description of Artificial Sequence: Synthetic oligonucleotide
tcccgactcaagcttgagtcggga

SEQ ID NO: 2453 - DNA, 24 bp, Artificial Sequence
  Description of Artificial Sequence: Synthetic oligonucleotide
gtccgactcaagcttgagtcggac

SEQ ID NO: 2454 - DNA, 24 bp, Artificial Sequence
  Description of Artificial Sequence: Synthetic oligonucleotide
gcctgactcaagcttgagtcaggc

SEQ ID NO: 2455 - DNA, 24 bp, Artificial Sequence
  Description of Artificial Sequence: Synthetic oligonucleotide
gggcgactcaagcttgagtcgccc

SEQ ID NO: 2456 - DNA, 24 bp, Artificial Sequence
  Description of Artificial Sequence: Synthetic oligonucleotide
aggcgactcaagcttgagtcgcct

SEQ ID NO: 2457 - DNA, 24 bp, Artificial Sequence
  Description of Artificial Sequence: Synthetic oligonucleotide
gagcgactcaagcttgagtcgctc

SEQ ID NO: 2458 - DNA, 24 bp, Artificial Sequence
  Description of Artificial Sequence: Synthetic oligonucleotide
ggacgactcaagcttgagtcgtcc

SEQ ID NO: 2459 - DNA, 24 bp, Artificial Sequence
  Description of Artificial Sequence: Synthetic oligonucleotide
gggagactcaagcttgagtctccc

SEQ ID NO: 2460 - DNA, 24 bp, Artificial Sequence
  Description of Artificial Sequence: Synthetic oligonucleotide
tggcgactcaagcttgagtcgcca

SEQ ID NO: 2461 - DNA, 24 bp, Artificial Sequence
  Description of Artificial Sequence: Synthetic oligonucleotide
gtgcgactcaagcttgagtcgcac

SEQ ID NO: 2462 - DNA, 24 bp, Artificial Sequence
  Description of Artificial Sequence: Synthetic oligonucleotide
gggtgactcaagcttgagtcaccc

SEQ ID NO: 2463 - DNA, 24 bp, Artificial Sequence
  Description of Artificial Sequence: Synthetic oligonucleotide
acgggactcaagcttgagtcccgt

SEQ ID NO: 2464 - DNA, 24 bp, Artificial Sequence
  Description of Artificial Sequence: Synthetic oligonucleotide
cagggactcaagcttgagtccctg

SEQ ID NO: 2465 - DNA, 24 bp, Artificial Sequence
  Description of Artificial Sequence: Synthetic oligonucleotide
ccaggactcaagcttgagtcctgg

SEQ ID NO: 2466 - DNA, 24 bp, Artificial Sequence
  Description of Artificial Sequence: Synthetic oligonucleotide
ccgagactcaagcttgagtctcgg

SEQ ID NO: 2467 - DNA, 24 bp, Artificial Sequence
  Description of Artificial Sequence: Synthetic oligonucleotide
tcgggactcaagcttgagtcccga

SEQ ID NO: 2468 - DNA, 24 bp, Artificial Sequence
  Description of Artificial Sequence: Synthetic oligonucleotide
ctgggactcaagcttgagtcccag

SEQ ID NO: 2469 - DNA, 24 bp, Artificial Sequence
  Description of Artificial Sequence: Synthetic oligonucleotide
cctggactcaagcttgagtccagg

SEQ ID NO: 2470 - DNA, 24 bp, Artificial Sequence
  Description of Artificial Sequence: Synthetic oligonucleotide
ccgtgactcaagcttgagtcacgg

SEQ ID NO: 2471 - DNA, 24 bp, Artificial Sequence
  Description of Artificial Sequence: Synthetic oligonucleotide
cggcgactcaagcttgagtcgccg

SEQ ID NO: 2472 - DNA, 24 bp, Artificial Sequence
  Description of Artificial Sequence: Synthetic oligonucleotide
cagcgactcaagcttgagtcgctg

SEQ ID NO: 2473 - DNA, 24 bp, Artificial Sequence
  Description of Artificial Sequence: Synthetic oligonucleotide
cgacgactcaagcttgagtcgtcg

SEQ ID NO: 2474 - DNA, 24 bp, Artificial Sequence
  Description of Artificial Sequence: Synthetic oligonucleotide
cggagactcaagcttgagtctccg

SEQ ID NO: 2475 - DNA, 24 bp, Artificial Sequence
  Description of Artificial Sequence: Synthetic oligonucleotide
ctgcgactcaagcttgagtcgcag

SEQ ID NO: 2476 - DNA, 24 bp, Artificial Sequence
  Description of Artificial Sequence: Synthetic oligonucleotide
cggtgactcaagcttgagtcaccg

SEQ ID NO: 2477 - DNA, 24 bp, Artificial Sequence
  Description of Artificial Sequence: Synthetic oligonucleotide
cacggactcaagcttgagtccgtg

SEQ ID NO: 2478 - DNA, 24 bp, Artificial Sequence
  Description of Artificial Sequence: Synthetic oligonucleotide
cccagactcaagcttgagtctggg

SEQ ID NO: 2479 - DNA, 24 bp, Artificial Sequence
  Description of Artificial Sequence: Synthetic oligonucleotide
ctcggactcaagcttgagtccgag

SEQ ID NO: 2480 - DNA, 24 bp, Artificial Sequence
  Description of Artificial Sequence: Synthetic oligonucleotide
ccctgactcaagcttgagtcaggg

SEQ ID NO: 2481 - DNA, 24 bp, Artificial Sequence
  Description of Artificial Sequence: Synthetic oligonucleotide
ccacgactcaagcttgagtcgtgg

SEQ ID NO: 2482 - DNA, 24 bp, Artificial Sequence
  Description of Artificial Sequence: Synthetic oligonucleotide
agccgactcaagcttgagtcggct

SEQ ID NO: 2483 - DNA, 24 bp, Artificial Sequence
  Description of Artificial Sequence: Synthetic oligonucleotide
tgccgactcaagcttgagtcggca

SEQ ID NO: 2484 - DNA, 24 bp, Artificial Sequence
  Description of Artificial Sequence: Synthetic oligonucleotide
gcgagactcaagcttgagtctcgc

SEQ ID NO: 2485 - DNA, 24 bp, Artificial Sequence
  Description of Artificial Sequence: Synthetic oligonucleotide
gcgtgactcaagcttgagtcacgc

SEQ ID NO: 2486 - DNA, 24 bp, Artificial Sequence
  Description of Artificial Sequence: Synthetic oligonucleotide
gcaggactcaagcttgagtcctgc

SEQ ID NO: 2487 - DNA, 24 bp, Artificial Sequence
  Description of Artificial Sequence: Synthetic oligonucleotide
gctggactcaagcttgagtccagc

SEQ ID NO: 2488 - DNA, 24 bp, Artificial Sequence
  Description of Artificial Sequence: Synthetic oligonucleotide
cgaggactcaagcttgagtcctcg

SEQ ID NO: 2489 - DNA, 24 bp, Artificial Sequence
  Description of Artificial Sequence: Synthetic oligonucleotide
cgtggactcaagcttgagtccacg

SEQ ID NO: 2490 - DNA, 24 bp, Artificial Sequence
  Description of Artificial Sequence: Synthetic oligonucleotide
caccgactcaagcttgagtcggtg

SEQ ID NO: 2491 - DNA, 24 bp, Artificial Sequence
  Description of Artificial Sequence: Synthetic oligonucleotide
ctccgactcaagcttgagtcggag

SEQ ID NO: 2492 - DNA, 24 bp, Artificial Sequence
  Description of Artificial Sequence: Synthetic oligonucleotide
gcgggactcaagcttgagtcccgc

SEQ ID NO: 2493 - DNA, 24 bp, Artificial Sequence
  Description of Artificial Sequence: Synthetic oligonucleotide
gagggactcaagcttgagtccctc

SEQ ID NO: 2494 - DNA, 24 bp, Artificial Sequence
  Description of Artificial Sequence: Synthetic oligonucleotide
gtgggactcaagcttgagtcccac

SEQ ID NO: 2495 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcaacgttgagtcnnnn

SEQ ID NO: 2496 - DNA, 24 bp, Artificial Sequence
  Description of Artificial Sequence: Synthetic oligonucleotide
ggcggactcaacgttgagtccgcc

SEQ ID NO: 2497 - DNA, 24 bp, Artificial Sequence
  Description of Artificial Sequence: Synthetic oligonucleotide
agcggactcaacgttgagtccgct

SEQ ID NO: 2498 - DNA, 24 bp, Artificial Sequence
  Description of Artificial Sequence: Synthetic oligonucleotide
gacggactcaacgttgagtccgtc

SEQ ID NO: 2499 - DNA, 24 bp, Artificial Sequence
  Description of Artificial Sequence: Synthetic oligonucleotide
ggaggactcaacgttgagtcctcc

SEQ ID NO: 2500 - DNA, 24 bp, Artificial Sequence
  Description of Artificial Sequence: Synthetic oligonucleotide
ggcagactcaacgttgagtctgcc

SEQ ID NO: 2501 - DNA, 24 bp, Artificial Sequence
  Description of Artificial Sequence: Synthetic oligonucleotide
tgcggactcaacgttgagtccgca

SEQ ID NO: 2502 - DNA, 24 bp, Artificial Sequence
  Description of Artificial Sequence: Synthetic oligonucleotide
gtcggactcaacgttgagtccgac

SEQ ID NO: 2503 - DNA, 24 bp, Artificial Sequence
  Description of Artificial Sequence: Synthetic oligonucleotide
ggtggactcaacgttgagtccacc

SEQ ID NO: 2504 - DNA, 24 bp, Artificial Sequence
  Description of Artificial Sequence: Synthetic oligonucleotide
ggctgactcaacgttgagtcagcc

SEQ ID NO: 2505 - DNA, 24 bp, Artificial Sequence
  Description of Artificial Sequence: Synthetic oligonucleotide
gcccgactcaacgttgagtcgggc

SEQ ID NO: 2506 - DNA, 24 bp, Artificial Sequence
  Description of Artificial Sequence: Synthetic oligonucleotide
acccgactcaacgttgagtcgggt

SEQ ID NO: 2507 - DNA, 24 bp, Artificial Sequence
  Description of Artificial Sequence: Synthetic oligonucleotide
gaccgactcaacgttgagtcggtc

SEQ ID NO: 2508 - DNA, 24 bp, Artificial Sequence
  Description of Artificial Sequence: Synthetic oligonucleotide
gcacgactcaacgttgagtcgtgc

SEQ ID NO: 2509 - DNA, 24 bp, Artificial Sequence
  Description of Artificial Sequence: Synthetic oligonucleotide
gccagactcaacgttgagtctggc

SEQ ID NO: 2510 - DNA, 24 bp, Artificial Sequence
  Description of Artificial Sequence: Synthetic oligonucleotide
tcccgactcaacgttgagtcggga

SEQ ID NO: 2511 - DNA, 24 bp, Artificial Sequence
  Description of Artificial Sequence: Synthetic oligonucleotide
gtccgactcaacgttgagtcggac

SEQ ID NO: 2512 - DNA, 24 bp, Artificial Sequence
  Description of Artificial Sequence: Synthetic oligonucleotide
gcctgactcaacgttgagtcaggc

SEQ ID NO: 2513 - DNA, 24 bp, Artificial Sequence
  Description of Artificial Sequence: Synthetic oligonucleotide
gggcgactcaacgttgagtcgccc

SEQ ID NO: 2514 - DNA, 24 bp, Artificial Sequence
  Description of Artificial Sequence: Synthetic oligonucleotide
aggcgactcaacgttgagtcgcct

SEQ ID NO: 2515 - DNA, 24 bp, Artificial Sequence
  Description of Artificial Sequence: Synthetic oligonucleotide
gagcgactcaacgttgagtcgctc

SEQ ID NO: 2516 - DNA, 24 bp, Artificial Sequence
  Description of Artificial Sequence: Synthetic oligonucleotide
ggacgactcaacgttgagtcgtcc

SEQ ID NO: 2517 - DNA, 24 bp, Artificial Sequence
  Description of Artificial Sequence: Synthetic oligonucleotide
gggagactcaacgttgagtctccc

SEQ ID NO: 2518 - DNA, 24 bp, Artificial Sequence
  Description of Artificial Sequence: Synthetic oligonucleotide
tggcgactcaacgttgagtcgcca

SEQ ID NO: 2519 - DNA, 24 bp, Artificial Sequence
  Description of Artificial Sequence: Synthetic oligonucleotide
gtgcgactcaacgttgagtcgcac

SEQ ID NO: 2520 - DNA, 24 bp, Artificial Sequence
  Description of Artificial Sequence: Synthetic oligonucleotide
gggtgactcaacgttgagtcaccc

SEQ ID NO: 2521 - DNA, 24 bp, Artificial Sequence
  Description of Artificial Sequence: Synthetic oligonucleotide
acgggactcaacgttgagtcccgt

SEQ ID NO: 2522 - DNA, 24 bp, Artificial Sequence
  Description of Artificial Sequence: Synthetic oligonucleotide
cagggactcaacgttgagtccctg

SEQ ID NO: 2523 - DNA, 24 bp, Artificial Sequence
  Description of Artificial Sequence: Synthetic oligonucleotide
ccaggactcaacgttgagtcctgg

SEQ ID NO: 2524 - DNA, 24 bp, Artificial Sequence
  Description of Artificial Sequence: Synthetic oligonucleotide
ccgagactcaacgttgagtctcgg

SEQ ID NO: 2525 - DNA, 24 bp, Artificial Sequence
  Description of Artificial Sequence: Synthetic oligonucleotide
tcgggactcaacgttgagtcccga

SEQ ID NO: 2526 - DNA, 24 bp, Artificial Sequence
  Description of Artificial Sequence: Synthetic oligonucleotide
ctgggactcaacgttgagtcccag

SEQ ID NO: 2527 - DNA, 24 bp, Artificial Sequence
  Description of Artificial Sequence: Synthetic oligonucleotide
cctggactcaacgttgagtccagg

SEQ ID NO: 2528 - DNA, 24 bp, Artificial Sequence
  Description of Artificial Sequence: Synthetic oligonucleotide
ccgtgactcaacgttgagtcacgg

SEQ ID NO: 2529 - DNA, 24 bp, Artificial Sequence
  Description of Artificial Sequence: Synthetic oligonucleotide
cggcgactcaacgttgagtcgccg

SEQ ID NO: 2530 - DNA, 24 bp, Artificial Sequence
  Description of Artificial Sequence: Synthetic oligonucleotide
cagcgactcaacgttgagtcgctg

SEQ ID NO: 2531 - DNA, 24 bp, Artificial Sequence
  Description of Artificial Sequence: Synthetic oligonucleotide
cgacgactcaacgttgagtcgtcg

SEQ ID NO: 2532 - DNA, 24 bp, Artificial Sequence
  Description of Artificial Sequence: Synthetic oligonucleotide
cggagactcaacgttgagtctccg

SEQ ID NO: 2533 - DNA, 24 bp, Artificial Sequence
  Description of Artificial Sequence: Synthetic oligonucleotide
ctgcgactcaacgttgagtcgcag

SEQ ID NO: 2534 - DNA, 24 bp, Artificial Sequence
  Description of Artificial Sequence: Synthetic oligonucleotide
cggtgactcaacgttgagtcaccg

SEQ ID NO: 2535 - DNA, 24 bp, Artificial Sequence
  Description of Artificial Sequence: Synthetic oligonucleotide
cacggactcaacgttgagtccgtg

SEQ ID NO: 2536 - DNA, 24 bp, Artificial Sequence
  Description of Artificial Sequence: Synthetic oligonucleotide
cccagactcaacgttgagtctggg

SEQ ID NO: 2537 - DNA, 24 bp, Artificial Sequence
  Description of Artificial Sequence: Synthetic oligonucleotide
ctcggactcaacgttgagtccgag

SEQ ID NO: 2538 - DNA, 24 bp, Artificial Sequence
  Description of Artificial Sequence: Synthetic oligonucleotide
ccctgactcaacgttgagtcaggg

SEQ ID NO: 2539 - DNA, 24 bp, Artificial Sequence
  Description of Artificial Sequence: Synthetic oligonucleotide
ccacgactcaacgttgagtcgtgg

SEQ ID NO: 2540 - DNA, 24 bp, Artificial Sequence
  Description of Artificial Sequence: Synthetic oligonucleotide
agccgactcaacgttgagtcggct

SEQ ID NO: 2541 - DNA, 24 bp, Artificial Sequence
  Description of Artificial Sequence: Synthetic oligonucleotide
tgccgactcaacgttgagtcggca

SEQ ID NO: 2542 - DNA, 24 bp, Artificial Sequence
  Description of Artificial Sequence: Synthetic oligonucleotide
gcgagactcaacgttgagtctcgc

SEQ ID NO: 2543 - DNA, 24 bp, Artificial Sequence
  Description of Artificial Sequence: Synthetic oligonucleotide
gcgtgactcaacgttgagtcacgc

SEQ ID NO: 2544 - DNA, 24 bp, Artificial Sequence
  Description of Artificial Sequence: Synthetic oligonucleotide
gcaggactcaacgttgagtcctgc

SEQ ID NO: 2545 - DNA, 24 bp, Artificial Sequence
  Description of Artificial Sequence: Synthetic oligonucleotide
gctggactcaacgttgagtccagc

SEQ ID NO: 2546 - DNA, 24 bp, Artificial Sequence
  Description of Artificial Sequence: Synthetic oligonucleotide
cgaggactcaacgttgagtcctcg

SEQ ID NO: 2547 - DNA, 24 bp, Artificial Sequence
  Description of Artificial Sequence: Synthetic oligonucleotide
cgtggactcaacgttgagtccacg

SEQ ID NO: 2548 - DNA, 24 bp, Artificial Sequence
  Description of Artificial Sequence: Synthetic oligonucleotide
caccgactcaacgttgagtcggtg

SEQ ID NO: 2549 - DNA, 24 bp, Artificial Sequence
  Description of Artificial Sequence: Synthetic oligonucleotide
ctccgactcaacgttgagtcggag

SEQ ID NO: 2550 - DNA, 24 bp, Artificial Sequence
  Description of Artificial Sequence: Synthetic oligonucleotide
gcgggactcaacgttgagtcccgc

SEQ ID NO: 2551 - DNA, 24 bp, Artificial Sequence
  Description of Artificial Sequence: Synthetic oligonucleotide
gagggactcaacgttgagtccctc

SEQ ID NO: 2552 - DNA, 24 bp, Artificial Sequence
  Description of Artificial Sequence: Synthetic oligonucleotide
gtgggactcaacgttgagtcccac

SEQ ID NO: 2553 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctaattagagtcnnnn

SEQ ID NO: 2554 - DNA, 24 bp, Artificial Sequence
  Description of Artificial Sequence: Synthetic oligonucleotide
ggcggactctaattagagtccgcc

SEQ ID NO: 2555 - DNA, 24 bp, Artificial Sequence
  Description of Artificial Sequence: Synthetic oligonucleotide
agcggactctaattagagtccgct

SEQ ID NO: 2556 - DNA, 24 bp, Artificial Sequence
  Description of Artificial Sequence: Synthetic oligonucleotide
gacggactctaattagagtccgtc

SEQ ID NO: 2557 - DNA, 24 bp, Artificial Sequence
  Description of Artificial Sequence: Synthetic oligonucleotide
ggaggactctaattagagtcctcc

SEQ ID NO: 2558 - DNA, 24 bp, Artificial Sequence
  Description of Artificial Sequence: Synthetic oligonucleotide
ggcagactctaattagagtctgcc

SEQ ID NO: 2559 - DNA, 24 bp, Artificial Sequence
  Description of Artificial Sequence: Synthetic oligonucleotide
tgcggactctaattagagtccgca

SEQ ID NO: 2560 - DNA, 24 bp, Artificial Sequence
  Description of Artificial Sequence: Synthetic oligonucleotide
gtcggactctaattagagtccgac

SEQ ID NO: 2561 - DNA, 24 bp, Artificial Sequence
  Description of Artificial Sequence: Synthetic oligonucleotide
ggtggactctaattagagtccacc

SEQ ID NO: 2562 - DNA, 24 bp, Artificial Sequence
  Description of Artificial Sequence: Synthetic oligonucleotide
ggctgactctaattagagtcagcc

SEQ ID NO: 2563 - DNA, 24 bp, Artificial Sequence
  Description of Artificial Sequence: Synthetic oligonucleotide
gcccgactctaattagagtcgggc

SEQ ID NO: 2564 - DNA, 24 bp, Artificial Sequence
  Description of Artificial Sequence: Synthetic oligonucleotide
acccgactctaattagagtcgggt

SEQ ID NO: 2565 - DNA, 24 bp, Artificial Sequence
  Description of Artificial Sequence: Synthetic oligonucleotide
gaccgactctaattagagtcggtc

SEQ ID NO: 2566 - DNA, 24 bp, Artificial Sequence
  Description of Artificial Sequence: Synthetic oligonucleotide
gcacgactctaattagagtcgtgc

SEQ ID NO: 2567 - DNA, 24 bp, Artificial Sequence
  Description of Artificial Sequence: Synthetic oligonucleotide
gccagactctaattagagtctggc

SEQ ID NO: 2568 - DNA, 24 bp, Artificial Sequence
  Description of Artificial Sequence: Synthetic oligonucleotide
tcccgactctaattagagtcggga

SEQ ID NO: 2569 - DNA, 24 bp, Artificial Sequence
  Description of Artificial Sequence: Synthetic oligonucleotide
gtccgactctaattagagtcggac

SEQ ID NO: 2570 - DNA, 24 bp, Artificial Sequence
  Description of Artificial Sequence: Synthetic oligonucleotide
gcctgactctaattagagtcaggc

SEQ ID NO: 2571 - DNA, 24 bp, Artificial Sequence
  Description of Artificial Sequence: Synthetic oligonucleotide
gggcgactctaattagagtcgccc

SEQ ID NO: 2572 - DNA, 24 bp, Artificial Sequence
  Description of Artificial Sequence: Synthetic oligonucleotide
aggcgactctaattagagtcgcct

SEQ ID NO: 2573 - DNA, 24 bp, Artificial Sequence
  Description of Artificial Sequence: Synthetic oligonucleotide
gagcgactctaattagagtcgctc

SEQ ID NO: 2574 - DNA, 24 bp, Artificial Sequence
  Description of Artificial Sequence: Synthetic oligonucleotide
ggacgactctaattagagtcgtcc

SEQ ID NO: 2575 - DNA, 24 bp, Artificial Sequence
  Description of Artificial Sequence: Synthetic oligonucleotide
gggagactctaattagagtctccc

SEQ ID NO: 2576 - DNA, 24 bp, Artificial Sequence
  Description of Artificial Sequence: Synthetic oligonucleotide
tggcgactctaattagagtcgcca

SEQ ID NO: 2577 - DNA, 24 bp, Artificial Sequence
  Description of Artificial Sequence: Synthetic oligonucleotide
gtgcgactctaattagagtcgcac

SEQ ID NO: 2578 - DNA, 24 bp, Artificial Sequence
  Description of Artificial Sequence: Synthetic oligonucleotide
gggtgactctaattagagtcaccc

SEQ ID NO: 2579 - DNA, 24 bp, Artificial Sequence
  Description of Artificial Sequence: Synthetic oligonucleotide
acgggactctaattagagtcccgt

SEQ ID NO: 2580 - DNA, 24 bp, Artificial Sequence
  Description of Artificial Sequence: Synthetic oligonucleotide
cagggactctaattagagtccctg

SEQ ID NO: 2581 - DNA, 24 bp, Artificial Sequence
  Description of Artificial Sequence: Synthetic oligonucleotide
ccaggactctaattagagtcctgg

SEQ ID NO: 2582 - DNA, 24 bp, Artificial Sequence
  Description of Artificial Sequence: Synthetic oligonucleotide
ccgagactctaattagagtctcgg

SEQ ID NO: 2583 - DNA, 24 bp, Artificial Sequence
  Description of Artificial Sequence: Synthetic oligonucleotide
tcgggactctaattagagtcccga

SEQ ID NO: 2584 - DNA, 24 bp, Artificial Sequence
  Description of Artificial Sequence: Synthetic oligonucleotide
ctgggactctaattagagtcccag

SEQ ID NO: 2585 - DNA, 24 bp, Artificial Sequence
  Description of Artificial Sequence: Synthetic oligonucleotide
cctggactctaattagagtccagg

SEQ ID NO: 2586 - DNA, 24 bp, Artificial Sequence
  Description of Artificial Sequence: Synthetic oligonucleotide
ccgtgactctaattagagtcacgg

SEQ ID NO: 2587 - DNA, 24 bp, Artificial Sequence
  Description of Artificial Sequence: Synthetic oligonucleotide
cggcgactctaattagagtcgccg

SEQ ID NO: 2588 - DNA, 24 bp, Artificial Sequence
  Description of Artificial Sequence: Synthetic oligonucleotide
cagcgactctaattagagtcgctg

SEQ ID NO: 2589 - DNA, 24 bp, Artificial Sequence
  Description of Artificial Sequence: Synthetic oligonucleotide
cgacgactctaattagagtcgtcg

SEQ ID NO: 2590 - DNA, 24 bp, Artificial Sequence
  Description of Artificial Sequence: Synthetic oligonucleotide
cggagactctaattagagtctccg

SEQ ID NO: 2591 - DNA, 24 bp, Artificial Sequence
  Description of Artificial Sequence: Synthetic oligonucleotide
ctgcgactctaattagagtcgcag

SEQ ID NO: 2592 - DNA, 24 bp, Artificial Sequence
  Description of Artificial Sequence: Synthetic oligonucleotide
cggtgactctaattagagtcaccg

SEQ ID NO: 2593 - DNA, 24 bp, Artificial Sequence
  Description of Artificial Sequence: Synthetic oligonucleotide
cacggactctaattagagtccgtg

SEQ ID NO: 2594 - DNA, 24 bp, Artificial Sequence
  Description of Artificial Sequence: Synthetic oligonucleotide
cccagactctaattagagtctggg

SEQ ID NO: 2595 - DNA, 24 bp, Artificial Sequence
  Description of Artificial Sequence: Synthetic oligonucleotide
ctcggactctaattagagtccgag

SEQ ID NO: 2596 - DNA, 24 bp, Artificial Sequence
  Description of Artificial Sequence: Synthetic oligonucleotide
ccctgactctaattagagtcaggg

SEQ ID NO: 2597 - DNA, 24 bp, Artificial Sequence
  Description of Artificial Sequence: Synthetic oligonucleotide
ccacgactctaattagagtcgtgg

SEQ ID NO: 2598 - DNA, 24 bp, Artificial Sequence
  Description of Artificial Sequence: Synthetic oligonucleotide
agccgactctaattagagtcggct

SEQ ID NO: 2599 - DNA, 24 bp, Artificial Sequence
  Description of Artificial Sequence: Synthetic oligonucleotide
tgccgactctaattagagtcggca

SEQ ID NO: 2600 - DNA, 24 bp, Artificial Sequence
  Description of Artificial Sequence: Synthetic oligonucleotide
gcgagactctaattagagtctcgc

SEQ ID NO: 2601 - DNA, 24 bp, Artificial Sequence
  Description of Artificial Sequence: Synthetic oligonucleotide
gcgtgactctaattagagtcacgc

SEQ ID NO: 2602 - DNA, 24 bp, Artificial Sequence
  Description of Artificial Sequence: Synthetic oligonucleotide
gcaggactctaattagagtcctgc

SEQ ID NO: 2603 - DNA, 24 bp, Artificial Sequence
  Description of Artificial Sequence: Synthetic oligonucleotide
gctggactctaattagagtccagc

SEQ ID NO: 2604 - DNA, 24 bp, Artificial Sequence
  Description of Artificial Sequence: Synthetic oligonucleotide
cgaggactctaattagagtcctcg

SEQ ID NO: 2605 - DNA, 24 bp, Artificial Sequence
  Description of Artificial Sequence: Synthetic oligonucleotide
cgtggactctaattagagtccacg

SEQ ID NO: 2606 - DNA, 24 bp, Artificial Sequence
  Description of Artificial Sequence: Synthetic oligonucleotide
caccgactctaattagagtcggtg

SEQ ID NO: 2607 - DNA, 24 bp, Artificial Sequence
  Description of Artificial Sequence: Synthetic oligonucleotide
ctccgactctaattagagtcggag

SEQ ID NO: 2608 - DNA, 24 bp, Artificial Sequence
  Description of Artificial Sequence: Synthetic oligonucleotide
gcgggactctaattagagtcccgc

SEQ ID NO: 2609 - DNA, 24 bp, Artificial Sequence
  Description of Artificial Sequence: Synthetic oligonucleotide
gagggactctaattagagtccctc

SEQ ID NO: 2610 - DNA, 24 bp, Artificial Sequence
  Description of Artificial Sequence: Synthetic oligonucleotide
gtgggactctaattagagtcccac

SEQ ID NO: 2611 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctatatagagtcnnnn

SEQ ID NO: 2612 - DNA, 24 bp, Artificial Sequence
  Description of Artificial Sequence: Synthetic oligonucleotide
ggcggactctatatagagtccgcc

SEQ ID NO: 2613 - DNA, 24 bp, Artificial Sequence
  Description of Artificial Sequence: Synthetic oligonucleotide
agcggactctatatagagtccgct

SEQ ID NO: 2614 - DNA, 24 bp, Artificial Sequence
  Description of Artificial Sequence: Synthetic oligonucleotide
gacggactctatatagagtccgtc

SEQ ID NO: 2615 - DNA, 24 bp, Artificial Sequence
  Description of Artificial Sequence: Synthetic oligonucleotide
ggaggactctatatagagtcctcc

SEQ ID NO: 2616 - DNA, 24 bp, Artificial Sequence
  Description of Artificial Sequence: Synthetic oligonucleotide
ggcagactctatatagagtctgcc

SEQ ID NO: 2617 - DNA, 24 bp, Artificial Sequence
  Description of Artificial Sequence: Synthetic oligonucleotide
tgcggactctatatagagtccgca

SEQ ID NO: 2618 - DNA, 24 bp, Artificial Sequence
  Description of Artificial Sequence: Synthetic oligonucleotide
gtcggactctatatagagtccgac

SEQ ID NO: 2619 - DNA, 24 bp, Artificial Sequence
  Description of Artificial Sequence: Synthetic oligonucleotide
ggtggactctatatagagtccacc

SEQ ID NO: 2620 - DNA, 24 bp, Artificial Sequence
  Description of Artificial Sequence: Synthetic oligonucleotide
ggctgactctatatagagtcagcc

SEQ ID NO: 2621 - DNA, 24 bp, Artificial Sequence
  Description of Artificial Sequence: Synthetic oligonucleotide
gcccgactctatatagagtcgggc

SEQ ID NO: 2622 - DNA, 24 bp, Artificial Sequence
  Description of Artificial Sequence: Synthetic oligonucleotide
acccgactctatatagagtcgggt

SEQ ID NO: 2623 - DNA, 24 bp, Artificial Sequence
  Description of Artificial Sequence: Synthetic oligonucleotide
gaccgactctatatagagtcggtc

SEQ ID NO: 2624 - DNA, 24 bp, Artificial Sequence
  Description of Artificial Sequence: Synthetic oligonucleotide
gcacgactctatatagagtcgtgc

SEQ ID NO: 2625 - DNA, 24 bp, Artificial Sequence
  Description of Artificial Sequence: Synthetic oligonucleotide
gccagactctatatagagtctggc

SEQ ID NO: 2626 - DNA, 24 bp, Artificial Sequence
  Description of Artificial Sequence: Synthetic oligonucleotide
tcccgactctatatagagtcggga

SEQ ID NO: 2627 - DNA, 24 bp, Artificial Sequence
  Description of Artificial Sequence: Synthetic oligonucleotide
gtccgactctatatagagtcggac

SEQ ID NO: 2628 - DNA, 24 bp, Artificial Sequence
  Description of Artificial Sequence: Synthetic oligonucleotide
gcctgactctatatagagtcaggc

SEQ ID NO: 2629 - DNA, 24 bp, Artificial Sequence
  Description of Artificial Sequence: Synthetic oligonucleotide
gggcgactctatatagagtcgccc

SEQ ID NO: 2630 - DNA, 24 bp, Artificial Sequence
  Description of Artificial Sequence: Synthetic oligonucleotide
aggcgactctatatagagtcgcct

SEQ ID NO: 2631 - DNA, 24 bp, Artificial Sequence
  Description of Artificial Sequence: Synthetic oligonucleotide
gagcgactctatatagagtcgctc

SEQ ID NO: 2632 - DNA, 24 bp, Artificial Sequence
  Description of Artificial Sequence: Synthetic oligonucleotide
ggacgactctatatagagtcgtcc

SEQ ID NO: 2633 - DNA, 24 bp, Artificial Sequence
  Description of Artificial Sequence: Synthetic oligonucleotide
gggagactctatatagagtctccc

SEQ ID NO: 2634 - DNA, 24 bp, Artificial Sequence
  Description of Artificial Sequence: Synthetic oligonucleotide
tggcgactctatatagagtcgcca

SEQ ID NO: 2635 - DNA, 24 bp, Artificial Sequence
  Description of Artificial Sequence: Synthetic oligonucleotide
gtgcgactctatatagagtcgcac

SEQ ID NO: 2636 - DNA, 24 bp, Artificial Sequence
  Description of Artificial Sequence: Synthetic oligonucleotide
gggtgactctatatagagtcaccc

SEQ ID NO: 2637 - DNA, 24 bp, Artificial Sequence
  Description of Artificial Sequence: Synthetic oligonucleotide
acgggactctatatagagtcccgt

SEQ ID NO: 2638 - DNA, 24 bp, Artificial Sequence
  Description of Artificial Sequence: Synthetic oligonucleotide
cagggactctatatagagtccctg

SEQ ID NO: 2639 - DNA, 24 bp, Artificial Sequence
  Description of Artificial Sequence: Synthetic oligonucleotide
ccaggactctatatagagtcctgg

SEQ ID NO: 2640 - DNA, 24 bp, Artificial Sequence
  Description of Artificial Sequence: Synthetic oligonucleotide
ccgagactctatatagagtctcgg

SEQ ID NO: 2641 - DNA, 24 bp, Artificial Sequence
  Description of Artificial Sequence: Synthetic oligonucleotide
tcgggactctatatagagtcccga

SEQ ID NO: 2642 - DNA, 24 bp, Artificial Sequence
  Description of Artificial Sequence: Synthetic oligonucleotide
ctgggactctatatagagtcccag

SEQ ID NO: 2643 - DNA, 24 bp, Artificial Sequence
  Description of Artificial Sequence: Synthetic oligonucleotide
cctggactctatatagagtccagg

SEQ ID NO: 2644 - DNA, 24 bp, Artificial Sequence
  Description of Artificial Sequence: Synthetic oligonucleotide
ccgtgactctatatagagtcacgg

SEQ ID NO: 2645 - DNA, 24 bp, Artificial Sequence
  Description of Artificial Sequence: Synthetic oligonucleotide
cggcgactctatatagagtcgccg

SEQ ID NO: 2646 - DNA, 24 bp, Artificial Sequence
  Description of Artificial Sequence: Synthetic oligonucleotide
cagcgactctatatagagtcgctg

SEQ ID NO: 2647 - DNA, 24 bp, Artificial Sequence
  Description of Artificial Sequence: Synthetic oligonucleotide
cgacgactctatatagagtcgtcg

SEQ ID NO: 2648 - DNA, 24 bp, Artificial Sequence
  Description of Artificial Sequence: Synthetic oligonucleotide
cggagactctatatagagtctccg

SEQ ID NO: 2649 - DNA, 24 bp, Artificial Sequence
  Description of Artificial Sequence: Synthetic oligonucleotide
ctgcgactctatatagagtcgcag

SEQ ID NO: 2650 - DNA, 24 bp, Artificial Sequence
  Description of Artificial Sequence: Synthetic oligonucleotide
cggtgactctatatagagtcaccg

SEQ ID NO: 2651 - DNA, 24 bp, Artificial Sequence
  Description of Artificial Sequence: Synthetic oligonucleotide
cacggactctatatagagtccgtg

SEQ ID NO: 2652 - DNA, 24 bp, Artificial Sequence
  Description of Artificial Sequence: Synthetic oligonucleotide
cccagactctatatagagtctggg

SEQ ID NO: 2653 - DNA, 24 bp, Artificial Sequence
  Description of Artificial Sequence: Synthetic oligonucleotide
ctcggactctatatagagtccgag

SEQ ID NO: 2654 - DNA, 24 bp, Artificial Sequence
  Description of Artificial Sequence: Synthetic oligonucleotide
ccctgactctatatagagtcaggg

SEQ ID NO: 2655 - DNA, 24 bp, Artificial Sequence
  Description of Artificial Sequence: Synthetic oligonucleotide
ccacgactctatatagagtcgtgg

SEQ ID NO: 2656 - DNA, 24 bp, Artificial Sequence
  Description of Artificial Sequence: Synthetic oligonucleotide
agccgactctatatagagtcggct

SEQ ID NO: 2657 - DNA, 24 bp, Artificial Sequence
  Description of Artificial Sequence: Synthetic oligonucleotide
tgccgactctatatagagtcggca

SEQ ID NO: 2658 - DNA, 24 bp, Artificial Sequence
  Description of Artificial Sequence: Synthetic oligonucleotide
gcgagactctatatagagtctcgc

SEQ ID NO: 2659 - DNA, 24 bp, Artificial Sequence
  Description of Artificial Sequence: Synthetic oligonucleotide
gcgtgactctatatagagtcacgc

SEQ ID NO: 2660 - DNA, 24 bp, Artificial Sequence
  Description of Artificial Sequence: Synthetic oligonucleotide
gcaggactctatatagagtcctgc

SEQ ID NO: 2661 - DNA, 24 bp, Artificial Sequence
  Description of Artificial Sequence: Synthetic oligonucleotide
gctggactctatatagagtccagc

SEQ ID NO: 2662 - DNA, 24 bp, Artificial Sequence
  Description of Artificial Sequence: Synthetic oligonucleotide
cgaggactctatatagagtcctcg

SEQ ID NO: 2663 - DNA, 24 bp, Artificial Sequence
  Description of Artificial Sequence: Synthetic oligonucleotide
cgtggactctatatagagtccacg

SEQ ID NO: 2664 - DNA, 24 bp, Artificial Sequence
  Description of Artificial Sequence: Synthetic oligonucleotide
caccgactctatatagagtcggtg

SEQ ID NO: 2665 - DNA, 24 bp, Artificial Sequence
  Description of Artificial Sequence: Synthetic oligonucleotide
ctccgactctatatagagtcggag

SEQ ID NO: 2666 - DNA, 24 bp, Artificial Sequence
  Description of Artificial Sequence: Synthetic oligonucleotide
gcgggactctatatagagtcccgc

SEQ ID NO: 2667 - DNA, 24 bp, Artificial Sequence
  Description of Artificial Sequence: Synthetic oligonucleotide
gagggactctatatagagtccctc

SEQ ID NO: 2668 - DNA, 24 bp, Artificial Sequence
  Description of Artificial Sequence: Synthetic oligonucleotide
gtgggactctatatagagtcccac

SEQ ID NO: 2669 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctagctagagtcnnnn

SEQ ID NO: 2670 - DNA, 24 bp, Artificial Sequence
  Description of Artificial Sequence: Synthetic oligonucleotide
ggcggactctagctagagtccgcc

SEQ ID NO: 2671 - DNA, 24 bp, Artificial Sequence
  Description of Artificial Sequence: Synthetic oligonucleotide
agcggactctagctagagtccgct

SEQ ID NO: 2672 - DNA, 24 bp, Artificial Sequence
  Description of Artificial Sequence: Synthetic oligonucleotide
gacggactctagctagagtccgtc

SEQ ID NO: 2673 - DNA, 24 bp, Artificial Sequence
  Description of Artificial Sequence: Synthetic oligonucleotide
ggaggactctagctagagtcctcc

SEQ ID NO: 2674 - DNA, 24 bp, Artificial Sequence
  Description of Artificial Sequence: Synthetic oligonucleotide
ggcagactctagctagagtctgcc

SEQ ID NO: 2675 - DNA, 24 bp, Artificial Sequence
  Description of Artificial Sequence: Synthetic oligonucleotide
tgcggactctagctagagtccgca

SEQ ID NO: 2676 - DNA, 24 bp, Artificial Sequence
  Description of Artificial Sequence: Synthetic oligonucleotide
gtcggactctagctagagtccgac

SEQ ID NO: 2677 - DNA, 24 bp, Artificial Sequence
  Description of Artificial Sequence: Synthetic oligonucleotide
ggtggactctagctagagtccacc

SEQ ID NO: 2678 - DNA, 24 bp, Artificial Sequence
  Description of Artificial Sequence: Synthetic oligonucleotide
ggctgactctagctagagtcagcc

SEQ ID NO: 2679 - DNA, 24 bp, Artificial Sequence
  Description of Artificial Sequence: Synthetic oligonucleotide
gcccgactctagctagagtcgggc

SEQ ID NO: 2680 - DNA, 24 bp, Artificial Sequence
  Description of Artificial Sequence: Synthetic oligonucleotide
acccgactctagctagagtcgggt

SEQ ID NO: 2681 - DNA, 24 bp, Artificial Sequence
  Description of Artificial Sequence: Synthetic oligonucleotide
gaccgactctagctagagtcggtc

SEQ ID NO: 2682 - DNA, 24 bp, Artificial Sequence
  Description of Artificial Sequence: Synthetic oligonucleotide
gcacgactctagctagagtcgtgc

SEQ ID NO: 2683 - DNA, 24 bp, Artificial Sequence
  Description of Artificial Sequence: Synthetic oligonucleotide
gccagactctagctagagtctggc

SEQ ID NO: 2684 - DNA, 24 bp, Artificial Sequence
  Description of Artificial Sequence: Synthetic oligonucleotide
tcccgactctagctagagtcggga

SEQ ID NO: 2685 - DNA, 24 bp, Artificial Sequence
  Description of Artificial Sequence: Synthetic oligonucleotide
gtccgactctagctagagtcggac

SEQ ID NO: 2686 - DNA, 24 bp, Artificial Sequence
  Description of Artificial Sequence: Synthetic oligonucleotide
gcctgactctagctagagtcaggc

SEQ ID NO: 2687 - DNA, 24 bp, Artificial Sequence
  Description of Artificial Sequence: Synthetic oligonucleotide
gggcgactctagctagagtcgccc

SEQ ID NO: 2688 - DNA, 24 bp, Artificial Sequence
  Description of Artificial Sequence: Synthetic oligonucleotide
aggcgactctagctagagtcgcct

SEQ ID NO: 2689 - DNA, 24 bp, Artificial Sequence
  Description of Artificial Sequence: Synthetic oligonucleotide
gagcgactctagctagagtcgctc

SEQ ID NO: 2690 - DNA, 24 bp, Artificial Sequence
  Description of Artificial Sequence: Synthetic oligonucleotide
ggacgactctagctagagtcgtcc

SEQ ID NO: 2691 - DNA, 24 bp, Artificial Sequence
  Description of Artificial Sequence: Synthetic oligonucleotide
gggagactctagctagagtctccc

SEQ ID NO: 2692 - DNA, 24 bp, Artificial Sequence
  Description of Artificial Sequence: Synthetic oligonucleotide
tggcgactctagctagagtcgcca

SEQ ID NO: 2693 - DNA, 24 bp, Artificial Sequence
  Description of Artificial Sequence: Synthetic oligonucleotide
gtgcgactctagctagagtcgcac

SEQ ID NO: 2694 - DNA, 24 bp, Artificial Sequence
  Description of Artificial Sequence: Synthetic oligonucleotide
gggtgactctagctagagtcaccc

SEQ ID NO: 2695 - DNA, 24 bp, Artificial Sequence
  Description of Artificial Sequence: Synthetic oligonucleotide
acgggactctagctagagtcccgt

SEQ ID NO: 2696 - DNA, 24 bp, Artificial Sequence
  Description of Artificial Sequence: Synthetic oligonucleotide
cagggactctagctagagtccctg

SEQ ID NO: 2697 - DNA, 24 bp, Artificial Sequence
  Description of Artificial Sequence: Synthetic oligonucleotide
ccaggactctagctagagtcctgg

SEQ ID NO: 2698 - DNA, 24 bp, Artificial Sequence
  Description of Artificial Sequence: Synthetic oligonucleotide
ccgagactctagctagagtctcgg

SEQ ID NO: 2699 - DNA, 24 bp, Artificial Sequence
  Description of Artificial Sequence: Synthetic oligonucleotide
tcgggactctagctagagtcccga

SEQ ID NO: 2700 - DNA, 24 bp, Artificial Sequence
  Description of Artificial Sequence: Synthetic oligonucleotide
ctgggactctagctagagtcccag

SEQ ID NO: 2701 - DNA, 24 bp, Artificial Sequence
  Description of Artificial Sequence: Synthetic oligonucleotide
cctggactctagctagagtccagg

SEQ ID NO: 2702 - DNA, 24 bp, Artificial Sequence
  Description of Artificial Sequence: Synthetic oligonucleotide
ccgtgactctagctagagtcacgg

SEQ ID NO: 2703 - DNA, 24 bp, Artificial Sequence
  Description of Artificial Sequence: Synthetic oligonucleotide
cggcgactctagctagagtcgccg

SEQ ID NO: 2704 - DNA, 24 bp, Artificial Sequence
  Description of Artificial Sequence: Synthetic oligonucleotide
cagcgactctagctagagtcgctg

SEQ ID NO: 2705 - DNA, 24 bp, Artificial Sequence
  Description of Artificial Sequence: Synthetic oligonucleotide
cgacgactctagctagagtcgtcg

SEQ ID NO: 2706 - DNA, 24 bp, Artificial Sequence
  Description of Artificial Sequence: Synthetic oligonucleotide
cggagactctagctagagtctccg

SEQ ID NO: 2707 - DNA, 24 bp, Artificial Sequence
  Description of Artificial Sequence: Synthetic oligonucleotide
ctgcgactctagctagagtcgcag

SEQ ID NO: 2708 - DNA, 24 bp, Artificial Sequence
  Description of Artificial Sequence: Synthetic oligonucleotide
cggtgactctagctagagtcaccg

SEQ ID NO: 2709 - DNA, 24 bp, Artificial Sequence
  Description of Artificial Sequence: Synthetic oligonucleotide
cacggactctagctagagtccgtg

SEQ ID NO: 2710 - DNA, 24 bp, Artificial Sequence
  Description of Artificial Sequence: Synthetic oligonucleotide
cccagactctagctagagtctggg

SEQ ID NO: 2711 - DNA, 24 bp, Artificial Sequence
  Description of Artificial Sequence: Synthetic oligonucleotide
ctcggactctagctagagtccgag

SEQ ID NO: 2712 - DNA, 24 bp, Artificial Sequence
  Description of Artificial Sequence: Synthetic oligonucleotide
ccctgactctagctagagtcaggg

SEQ ID NO: 2713 - DNA, 24 bp, Artificial Sequence
  Description of Artificial Sequence: Synthetic oligonucleotide
ccacgactctagctagagtcgtgg

SEQ ID NO: 2714 - DNA, 24 bp, Artificial Sequence
  Description of Artificial Sequence: Synthetic oligonucleotide
agccgactctagctagagtcggct

SEQ ID NO: 2715 - DNA, 24 bp, Artificial Sequence
  Description of Artificial Sequence: Synthetic oligonucleotide
tgccgactctagctagagtcggca

SEQ ID NO: 2716 - DNA, 24 bp, Artificial Sequence
  Description of Artificial Sequence: Synthetic oligonucleotide
gcgagactctagctagagtctcgc

SEQ ID NO: 2717 - DNA, 24 bp, Artificial Sequence
  Description of Artificial Sequence: Synthetic oligonucleotide
gcgtgactctagctagagtcacgc

SEQ ID NO: 2718 - DNA, 24 bp, Artificial Sequence
  Description of Artificial Sequence: Synthetic oligonucleotide
gcaggactctagctagagtcctgc

SEQ ID NO: 2719 - DNA, 24 bp, Artificial Sequence
  Description of Artificial Sequence: Synthetic oligonucleotide
gctggactctagctagagtccagc

SEQ ID NO: 2720 - DNA, 24 bp, Artificial Sequence
  Description of Artificial Sequence: Synthetic oligonucleotide
cgaggactctagctagagtcctcg

SEQ ID NO: 2721 - DNA, 24 bp, Artificial Sequence
  Description of Artificial Sequence: Synthetic oligonucleotide
cgtggactctagctagagtccacg

SEQ ID NO: 2722 - DNA, 24 bp, Artificial Sequence
  Description of Artificial Sequence: Synthetic oligonucleotide
caccgactctagctagagtcggtg

SEQ ID NO: 2723 - DNA, 24 bp, Artificial Sequence
  Description of Artificial Sequence: Synthetic oligonucleotide
ctccgactctagctagagtcggag

SEQ ID NO: 2724 - DNA, 24 bp, Artificial Sequence
  Description of Artificial Sequence: Synthetic oligonucleotide
gcgggactctagctagagtcccgc

SEQ ID NO: 2725 - DNA, 24 bp, Artificial Sequence
  Description of Artificial Sequence: Synthetic oligonucleotide
gagggactctagctagagtccctc

SEQ ID NO: 2726 - DNA, 24 bp, Artificial Sequence
  Description of Artificial Sequence: Synthetic oligonucleotide
gtgggactctagctagagtcccac

SEQ ID NO: 2727 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctacgtagagtcnnnn

SEQ ID NO: 2728 - DNA, 24 bp, Artificial Sequence
  Description of Artificial Sequence: Synthetic oligonucleotide
ggcggactctacgtagagtccgcc

SEQ ID NO: 2729 - DNA, 24 bp, Artificial Sequence
  Description of Artificial Sequence: Synthetic oligonucleotide
agcggactctacgtagagtccgct

SEQ ID NO: 2730 - DNA, 24 bp, Artificial Sequence
  Description of Artificial Sequence: Synthetic oligonucleotide
gacggactctacgtagagtccgtc

SEQ ID NO: 2731 - DNA, 24 bp, Artificial Sequence
  Description of Artificial Sequence: Synthetic oligonucleotide
ggaggactctacgtagagtcctcc

SEQ ID NO: 2732 - DNA, 24 bp, Artificial Sequence
  Description of Artificial Sequence: Synthetic oligonucleotide
ggcagactctacgtagagtctgcc

SEQ ID NO: 2733 - DNA, 24 bp, Artificial Sequence
  Description of Artificial Sequence: Synthetic oligonucleotide
tgcggactctacgtagagtccgca

SEQ ID NO: 2734 - DNA, 24 bp, Artificial Sequence
  Description of Artificial Sequence: Synthetic oligonucleotide
gtcggactctacgtagagtccgac

SEQ ID NO: 2735 - DNA, 24 bp, Artificial Sequence
  Description of Artificial Sequence: Synthetic oligonucleotide
ggtggactctacgtagagtccacc

SEQ ID NO: 2736 - DNA, 24 bp, Artificial Sequence
  Description of Artificial Sequence: Synthetic oligonucleotide
ggctgactctacgtagagtcagcc

SEQ ID NO: 2737 - DNA, 24 bp, Artificial Sequence
  Description of Artificial Sequence: Synthetic oligonucleotide
gcccgactctacgtagagtcgggc

SEQ ID NO: 2738 - DNA, 24 bp, Artificial Sequence
  Description of Artificial Sequence: Synthetic oligonucleotide
acccgactctacgtagagtcgggt

SEQ ID NO: 2739 - DNA, 24 bp, Artificial Sequence
  Description of Artificial Sequence: Synthetic oligonucleotide
gaccgactctacgtagagtcggtc

SEQ ID NO: 2740 - DNA, 24 bp, Artificial Sequence
  Description of Artificial Sequence: Synthetic oligonucleotide
gcacgactctacgtagagtcgtgc

SEQ ID NO: 2741 - DNA, 24 bp, Artificial Sequence
  Description of Artificial Sequence: Synthetic oligonucleotide
gccagactctacgtagagtctggc

SEQ ID NO: 2742 - DNA, 24 bp, Artificial Sequence
  Description of Artificial Sequence: Synthetic oligonucleotide
tcccgactctacgtagagtcggga

SEQ ID NO: 2743 - DNA, 24 bp, Artificial Sequence
  Description of Artificial Sequence: Synthetic oligonucleotide
gtccgactctacgtagagtcggac

SEQ ID NO: 2744 - DNA, 24 bp, Artificial Sequence
  Description of Artificial Sequence: Synthetic oligonucleotide
gcctgactctacgtagagtcaggc

SEQ ID NO: 2745 - DNA, 24 bp, Artificial Sequence
  Description of Artificial Sequence: Synthetic oligonucleotide
gggcgactctacgtagagtcgccc

SEQ ID NO: 2746 - DNA, 24 bp, Artificial Sequence
  Description of Artificial Sequence: Synthetic oligonucleotide
aggcgactctacgtagagtcgcct

SEQ ID NO: 2747 - DNA, 24 bp, Artificial Sequence
  Description of Artificial Sequence: Synthetic oligonucleotide
gagcgactctacgtagagtcgctc

SEQ ID NO: 2748 - DNA, 24 bp, Artificial Sequence
  Description of Artificial Sequence: Synthetic oligonucleotide
ggacgactctacgtagagtcgtcc

SEQ ID NO: 2749 - DNA, 24 bp, Artificial Sequence
  Description of Artificial Sequence: Synthetic oligonucleotide
gggagactctacgtagagtctccc

SEQ ID NO: 2750 - DNA, 24 bp, Artificial Sequence
  Description of Artificial Sequence: Synthetic oligonucleotide
tggcgactctacgtagagtcgcca

SEQ ID NO: 2751 - DNA, 24 bp, Artificial Sequence
  Description of Artificial Sequence: Synthetic oligonucleotide
gtgcgactctacgtagagtcgcac

SEQ ID NO: 2752 - DNA, 24 bp, Artificial Sequence
  Description of Artificial Sequence: Synthetic oligonucleotide
gggtgactctacgtagagtcaccc

SEQ ID NO: 2753 - DNA, 24 bp, Artificial Sequence
  Description of Artificial Sequence: Synthetic oligonucleotide
acgggactctacgtagagtcccgt

SEQ ID NO: 2754 - DNA, 24 bp, Artificial Sequence
  Description of Artificial Sequence: Synthetic oligonucleotide
cagggactctacgtagagtccctg

SEQ ID NO: 2755 - DNA, 24 bp, Artificial Sequence
  Description of Artificial Sequence: Synthetic oligonucleotide
ccaggactctacgtagagtcctgg

SEQ ID NO: 2756 - DNA, 24 bp, Artificial Sequence
  Description of Artificial Sequence: Synthetic oligonucleotide
ccgagactctacgtagagtctcgg

SEQ ID NO: 2757 - DNA, 24 bp, Artificial Sequence
  Description of Artificial Sequence: Synthetic oligonucleotide
tcgggactctacgtagagtcccga

SEQ ID NO: 2758 - DNA, 24 bp, Artificial Sequence
  Description of Artificial Sequence: Synthetic oligonucleotide
ctgggactctacgtagagtcccag

SEQ ID NO: 2759 - DNA, 24 bp, Artificial Sequence
  Description of Artificial Sequence: Synthetic oligonucleotide
cctggactctacgtagagtccagg

SEQ ID NO: 2760 - DNA, 24 bp, Artificial Sequence
  Description of Artificial Sequence: Synthetic oligonucleotide
ccgtgactctacgtagagtcacgg

SEQ ID NO: 2761 - DNA, 24 bp, Artificial Sequence
  Description of Artificial Sequence: Synthetic oligonucleotide
cggcgactctacgtagagtcgccg

SEQ ID NO: 2762 - DNA, 24 bp, Artificial Sequence
  Description of Artificial Sequence: Synthetic oligonucleotide
cagcgactctacgtagagtcgctg

SEQ ID NO: 2763 - DNA, 24 bp, Artificial Sequence
  Description of Artificial Sequence: Synthetic oligonucleotide
cgacgactctacgtagagtcgtcg

SEQ ID NO: 2764 - DNA, 24 bp, Artificial Sequence
  Description of Artificial Sequence: Synthetic oligonucleotide
cggagactctacgtagagtctccg

SEQ ID NO: 2765 - DNA, 24 bp, Artificial Sequence
  Description of Artificial Sequence: Synthetic oligonucleotide
ctgcgactctacgtagagtcgcag

SEQ ID NO: 2766 - DNA, 24 bp, Artificial Sequence
  Description of Artificial Sequence: Synthetic oligonucleotide
cggtgactctacgtagagtcaccg

SEQ ID NO: 2767 - DNA, 24 bp, Artificial Sequence
  Description of Artificial Sequence: Synthetic oligonucleotide
cacggactctacgtagagtccgtg

SEQ ID NO: 2768 - DNA, 24 bp, Artificial Sequence
  Description of Artificial Sequence: Synthetic oligonucleotide
cccagactctacgtagagtctggg

SEQ ID NO: 2769 - DNA, 24 bp, Artificial Sequence
  Description of Artificial Sequence: Synthetic oligonucleotide
ctcggactctacgtagagtccgag

SEQ ID NO: 2770 - DNA, 24 bp, Artificial Sequence
  Description of Artificial Sequence: Synthetic oligonucleotide
ccctgactctacgtagagtcaggg

SEQ ID NO: 2771 - DNA, 24 bp, Artificial Sequence
  Description of Artificial Sequence: Synthetic oligonucleotide
ccacgactctacgtagagtcgtgg

SEQ ID NO: 2772 - DNA, 24 bp, Artificial Sequence
  Description of Artificial Sequence: Synthetic oligonucleotide
agccgactctacgtagagtcggct

SEQ ID NO: 2773 - DNA, 24 bp, Artificial Sequence
  Description of Artificial Sequence: Synthetic oligonucleotide
tgccgactctacgtagagtcggca

SEQ ID NO: 2774 - DNA, 24 bp, Artificial Sequence
  Description of Artificial Sequence: Synthetic oligonucleotide
gcgagactctacgtagagtctcgc

SEQ ID NO: 2775 - DNA, 24 bp, Artificial Sequence
  Description of Artificial Sequence: Synthetic oligonucleotide
gcgtgactctacgtagagtcacgc

SEQ ID NO: 2776 - DNA, 24 bp, Artificial Sequence
  Description of Artificial Sequence: Synthetic oligonucleotide
gcaggactctacgtagagtcctgc

SEQ ID NO: 2777 - DNA, 24 bp, Artificial Sequence
  Description of Artificial Sequence: Synthetic oligonucleotide
gctggactctacgtagagtccagc

SEQ ID NO: 2778 - DNA, 24 bp, Artificial Sequence
  Description of Artificial Sequence: Synthetic oligonucleotide
cgaggactctacgtagagtcctcg

SEQ ID NO: 2779 - DNA, 24 bp, Artificial Sequence
  Description of Artificial Sequence: Synthetic oligonucleotide
cgtggactctacgtagagtccacg

SEQ ID NO: 2780 - DNA, 24 bp, Artificial Sequence
  Description of Artificial Sequence: Synthetic oligonucleotide
caccgactctacgtagagtcggtg

SEQ ID NO: 2781 - DNA, 24 bp, Artificial Sequence
  Description of Artificial Sequence: Synthetic oligonucleotide
ctccgactctacgtagagtcggag

SEQ ID NO: 2782 - DNA, 24 bp, Artificial Sequence
  Description of Artificial Sequence: Synthetic oligonucleotide
gcgggactctacgtagagtcccgc

SEQ ID NO: 2783 - DNA, 24 bp, Artificial Sequence
  Description of Artificial Sequence: Synthetic oligonucleotide
gagggactctacgtagagtccctc

SEQ ID NO: 2784 - DNA, 24 bp, Artificial Sequence
  Description of Artificial Sequence: Synthetic oligonucleotide
gtgggactctacgtagagtcccac

SEQ ID NO: 2785 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcatatatgagtcnnnn

SEQ ID NO: 2786 - DNA, 24 bp, Artificial Sequence
  Description of Artificial Sequence: Synthetic oligonucleotide
ggcggactcatatatgagtccgcc

SEQ ID NO: 2787 - DNA, 24 bp, Artificial Sequence
  Description of Artificial Sequence: Synthetic oligonucleotide
agcggactcatatatgagtccgct

SEQ ID NO: 2788 - DNA, 24 bp, Artificial Sequence
  Description of Artificial Sequence: Synthetic oligonucleotide
gacggactcatatatgagtccgtc

SEQ ID NO: 2789 - DNA, 24 bp, Artificial Sequence
  Description of Artificial Sequence: Synthetic oligonucleotide
ggaggactcatatatgagtcctcc

SEQ ID NO: 2790 - DNA, 24 bp, Artificial Sequence
  Description of Artificial Sequence: Synthetic oligonucleotide
ggcagactcatatatgagtctgcc

SEQ ID NO: 2791 - DNA, 24 bp, Artificial Sequence
  Description of Artificial Sequence: Synthetic oligonucleotide
tgcggactcatatatgagtccgca

SEQ ID NO: 2792 - DNA, 24 bp, Artificial Sequence
  Description of Artificial Sequence: Synthetic oligonucleotide
gtcggactcatatatgagtccgac

SEQ ID NO: 2793 - DNA, 24 bp, Artificial Sequence
  Description of Artificial Sequence: Synthetic oligonucleotide
ggtggactcatatatgagtccacc

SEQ ID NO: 2794 - DNA, 24 bp, Artificial Sequence
  Description of Artificial Sequence: Synthetic oligonucleotide
ggctgactcatatatgagtcagcc

SEQ ID NO: 2795 - DNA, 24 bp, Artificial Sequence
  Description of Artificial Sequence: Synthetic oligonucleotide
gcccgactcatatatgagtcgggc

SEQ ID NO: 2796 - DNA, 24 bp, Artificial Sequence
  Description of Artificial Sequence: Synthetic oligonucleotide
acccgactcatatatgagtcgggt

SEQ ID NO: 2797 - DNA, 24 bp, Artificial Sequence
  Description of Artificial Sequence: Synthetic oligonucleotide
gaccgactcatatatgagtcggtc

SEQ ID NO: 2798 - DNA, 24 bp, Artificial Sequence
  Description of Artificial Sequence: Synthetic oligonucleotide
gcacgactcatatatgagtcgtgc

SEQ ID NO: 2799 - DNA, 24 bp, Artificial Sequence
  Description of Artificial Sequence: Synthetic oligonucleotide
gccagactcatatatgagtctggc

SEQ ID NO: 2800 - DNA, 24 bp, Artificial Sequence
  Description of Artificial Sequence: Synthetic oligonucleotide
tcccgactcatatatgagtcggga

SEQ ID NO: 2801 - DNA, 24 bp, Artificial Sequence
  Description of Artificial Sequence: Synthetic oligonucleotide
gtccgactcatatatgagtcggac

SEQ ID NO: 2802 - DNA, 24 bp, Artificial Sequence
  Description of Artificial Sequence: Synthetic oligonucleotide
gcctgactcatatatgagtcaggc

SEQ ID NO: 2803 - DNA, 24 bp, Artificial Sequence
  Description of Artificial Sequence: Synthetic oligonucleotide
gggcgactcatatatgagtcgccc

SEQ ID NO: 2804 - DNA, 24 bp, Artificial Sequence
  Description of Artificial Sequence: Synthetic oligonucleotide
aggcgactcatatatgagtcgcct

SEQ ID NO: 2805 - DNA, 24 bp, Artificial Sequence
  Description of Artificial Sequence: Synthetic oligonucleotide
gagcgactcatatatgagtcgctc

SEQ ID NO: 2806 - DNA, 24 bp, Artificial Sequence
  Description of Artificial Sequence: Synthetic oligonucleotide
ggacgactcatatatgagtcgtcc

SEQ ID NO: 2807 - DNA, 24 bp, Artificial Sequence
  Description of Artificial Sequence: Synthetic oligonucleotide
gggagactcatatatgagtctccc

SEQ ID NO: 2808 - DNA, 24 bp, Artificial Sequence
  Description of Artificial Sequence: Synthetic oligonucleotide
tggcgactcatatatgagtcgcca

SEQ ID NO: 2809 - DNA, 24 bp, Artificial Sequence
  Description of Artificial Sequence: Synthetic oligonucleotide
gtgcgactcatatatgagtcgcac

SEQ ID NO: 2810 - DNA, 24 bp, Artificial Sequence
  Description of Artificial Sequence: Synthetic oligonucleotide
gggtgactcatatatgagtcaccc

SEQ ID NO: 2811 - DNA, 24 bp, Artificial Sequence
  Description of Artificial Sequence: Synthetic oligonucleotide
acgggactcatatatgagtcccgt

SEQ ID NO: 2812 - DNA, 24 bp, Artificial Sequence
  Description of Artificial Sequence: Synthetic oligonucleotide
cagggactcatatatgagtccctg

SEQ ID NO: 2813 - DNA, 24 bp, Artificial Sequence
  Description of Artificial Sequence: Synthetic oligonucleotide
ccaggactcatatatgagtcctgg

SEQ ID NO: 2814 - DNA, 24 bp, Artificial Sequence
  Description of Artificial Sequence: Synthetic oligonucleotide
ccgagactcatatatgagtctcgg

SEQ ID NO: 2815 - DNA, 24 bp, Artificial Sequence
  Description of Artificial Sequence: Synthetic oligonucleotide
tcgggactcatatatgagtcccga

SEQ ID NO: 2816 - DNA, 24 bp, Artificial Sequence
  Description of Artificial Sequence: Synthetic oligonucleotide
ctgggactcatatatgagtcccag

SEQ ID NO: 2817 - DNA, 24 bp, Artificial Sequence
  Description of Artificial Sequence: Synthetic oligonucleotide
cctggactcatatatgagtccagg

SEQ ID NO: 2818 - DNA, 24 bp, Artificial Sequence
  Description of Artificial Sequence: Synthetic oligonucleotide
ccgtgactcatatatgagtcacgg

SEQ ID NO: 2819 - DNA, 24 bp, Artificial Sequence
  Description of Artificial Sequence: Synthetic oligonucleotide
cggcgactcatatatgagtcgccg

SEQ ID NO: 2820 - DNA, 24 bp, Artificial Sequence
  Description of Artificial Sequence: Synthetic oligonucleotide
cagcgactcatatatgagtcgctg

SEQ ID NO: 2821 - DNA, 24 bp, Artificial Sequence
  Description of Artificial Sequence: Synthetic oligonucleotide
cgacgactcatatatgagtcgtcg

SEQ ID NO: 2822 - DNA, 24 bp, Artificial Sequence
  Description of Artificial Sequence: Synthetic oligonucleotide
cggagactcatatatgagtctccg

SEQ ID NO: 2823 - DNA, 24 bp, Artificial Sequence
  Description of Artificial Sequence: Synthetic oligonucleotide
ctgcgactcatatatgagtcgcag

SEQ ID NO: 2824 - DNA, 24 bp, Artificial Sequence
  Description of Artificial Sequence: Synthetic oligonucleotide
cggtgactcatatatgagtcaccg

SEQ ID NO: 2825 - DNA, 24 bp, Artificial Sequence
  Description of Artificial Sequence: Synthetic oligonucleotide
cacggactcatatatgagtccgtg

SEQ ID NO: 2826 - DNA, 24 bp, Artificial Sequence
  Description of Artificial Sequence: Synthetic oligonucleotide
cccagactcatatatgagtctggg

SEQ ID NO: 2827 - DNA, 24 bp, Artificial Sequence
  Description of Artificial Sequence: Synthetic oligonucleotide
ctcggactcatatatgagtccgag

SEQ ID NO: 2828 - DNA, 24 bp, Artificial Sequence
  Description of Artificial Sequence: Synthetic oligonucleotide
ccctgactcatatatgagtcaggg

SEQ ID NO: 2829 - DNA, 24 bp, Artificial Sequence
  Description of Artificial Sequence: Synthetic oligonucleotide
ccacgactcatatatgagtcgtgg

SEQ ID NO: 2830 - DNA, 24 bp, Artificial Sequence
  Description of Artificial Sequence: Synthetic oligonucleotide
agccgactcatatatgagtcggct

SEQ ID NO: 2831 - DNA, 24 bp, Artificial Sequence
  Description of Artificial Sequence: Synthetic oligonucleotide
tgccgactcatatatgagtcggca

SEQ ID NO: 2832 - DNA, 24 bp, Artificial Sequence
  Description of Artificial Sequence: Synthetic oligonucleotide
gcgagactcatatatgagtctcgc

SEQ ID NO: 2833 - DNA, 24 bp, Artificial Sequence
  Description of Artificial Sequence: Synthetic oligonucleotide
gcgtgactcatatatgagtcacgc

SEQ ID NO: 2834 - DNA, 24 bp, Artificial Sequence
  Description of Artificial Sequence: Synthetic oligonucleotide
gcaggactcatatatgagtcctgc

SEQ ID NO: 2835 - DNA, 24 bp, Artificial Sequence
  Description of Artificial Sequence: Synthetic oligonucleotide
gctggactcatatatgagtccagc

SEQ ID NO: 2836 - DNA, 24 bp, Artificial Sequence
  Description of Artificial Sequence: Synthetic oligonucleotide
cgaggactcatatatgagtcctcg

SEQ ID NO: 2837 - DNA, 24 bp, Artificial Sequence
  Description of Artificial Sequence: Synthetic oligonucleotide
cgtggactcatatatgagtccacg

SEQ ID NO: 2838 - DNA, 24 bp, Artificial Sequence
  Description of Artificial Sequence: Synthetic oligonucleotide
caccgactcatatatgagtcggtg

SEQ ID NO: 2839 - DNA, 24 bp, Artificial Sequence
  Description of Artificial Sequence: Synthetic oligonucleotide
ctccgactcatatatgagtcggag

SEQ ID NO: 2840 - DNA, 24 bp, Artificial Sequence
  Description of Artificial Sequence: Synthetic oligonucleotide
gcgggactcatatatgagtcccgc

SEQ ID NO: 2841 - DNA, 24 bp, Artificial Sequence
  Description of Artificial Sequence: Synthetic oligonucleotide
gagggactcatatatgagtccctc

SEQ ID NO: 2842 - DNA, 24 bp, Artificial Sequence
  Description of Artificial Sequence: Synthetic oligonucleotide
gtgggactcatatatgagtcccac

SEQ ID NO: 2843 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcattaatgagtcnnnn

SEQ ID NO: 2844 - DNA, 24 bp, Artificial Sequence
  Description of Artificial Sequence: Synthetic oligonucleotide
ggcggactcattaatgagtccgcc

SEQ ID NO: 2845 - DNA, 24 bp, Artificial Sequence
  Description of Artificial Sequence: Synthetic oligonucleotide
agcggactcattaatgagtccgct

SEQ ID NO: 2846 - DNA, 24 bp, Artificial Sequence
  Description of Artificial Sequence: Synthetic oligonucleotide
gacggactcattaatgagtccgtc

SEQ ID NO: 2847 - DNA, 24 bp, Artificial Sequence
  Description of Artificial Sequence: Synthetic oligonucleotide
ggaggactcattaatgagtcctcc

SEQ ID NO: 2848 - DNA, 24 bp, Artificial Sequence
  Description of Artificial Sequence: Synthetic oligonucleotide
ggcagactcattaatgagtctgcc

SEQ ID NO: 2849 - DNA, 24 bp, Artificial Sequence
  Description of Artificial Sequence: Synthetic oligonucleotide
tgcggactcattaatgagtccgca

SEQ ID NO: 2850 - DNA, 24 bp, Artificial Sequence
  Description of Artificial Sequence: Synthetic oligonucleotide
gtcggactcattaatgagtccgac

SEQ ID NO: 2851 - DNA, 24 bp, Artificial Sequence
  Description of Artificial Sequence: Synthetic oligonucleotide
ggtggactcattaatgagtccacc

SEQ ID NO: 2852 - DNA, 24 bp, Artificial Sequence
  Description of Artificial Sequence: Synthetic oligonucleotide
ggctgactcattaatgagtcagcc

SEQ ID NO: 2853 - DNA, 24 bp, Artificial Sequence
  Description of Artificial Sequence: Synthetic oligonucleotide
gcccgactcattaatgagtcgggc

SEQ ID NO: 2854 - DNA, 24 bp, Artificial Sequence
  Description of Artificial Sequence: Synthetic oligonucleotide
acccgactcattaatgagtcgggt

SEQ ID NO: 2855 - DNA, 24 bp, Artificial Sequence
  Description of Artificial Sequence: Synthetic oligonucleotide
gaccgactcattaatgagtcggtc

SEQ ID NO: 2856 - DNA, 24 bp, Artificial Sequence
  Description of Artificial Sequence: Synthetic oligonucleotide
gcacgactcattaatgagtcgtgc

SEQ ID NO: 2857 - DNA, 24 bp, Artificial Sequence
  Description of Artificial Sequence: Synthetic oligonucleotide
gccagactcattaatgagtctggc

SEQ ID NO: 2858 - DNA, 24 bp, Artificial Sequence
  Description of Artificial Sequence: Synthetic oligonucleotide
tcccgactcattaatgagtcggga

SEQ ID NO: 2859 - DNA, 24 bp, Artificial Sequence
  Description of Artificial Sequence: Synthetic oligonucleotide
gtccgactcattaatgagtcggac

SEQ ID NO: 2860 - DNA, 24 bp, Artificial Sequence
  Description of Artificial Sequence: Synthetic oligonucleotide
gcctgactcattaatgagtcaggc

SEQ ID NO: 2861 - DNA, 24 bp, Artificial Sequence
  Description of Artificial Sequence: Synthetic oligonucleotide
gggcgactcattaatgagtcgccc

SEQ ID NO: 2862 - DNA, 24 bp, Artificial Sequence
  Description of Artificial Sequence: Synthetic oligonucleotide
aggcgactcattaatgagtcgcct

SEQ ID NO: 2863 - DNA, 24 bp, Artificial Sequence
  Description of Artificial Sequence: Synthetic oligonucleotide
gagcgactcattaatgagtcgctc

SEQ ID NO: 2864 - DNA, 24 bp, Artificial Sequence
  Description of Artificial Sequence: Synthetic oligonucleotide
ggacgactcattaatgagtcgtcc

SEQ ID NO: 2865 - DNA, 24 bp, Artificial Sequence
  Description of Artificial Sequence: Synthetic oligonucleotide
gggagactcattaatgagtctccc

SEQ ID NO: 2866 - DNA, 24 bp, Artificial Sequence
  Description of Artificial Sequence: Synthetic oligonucleotide
tggcgactcattaatgagtcgcca

SEQ ID NO: 2867 - DNA, 24 bp, Artificial Sequence
  Description of Artificial Sequence: Synthetic oligonucleotide
gtgcgactcattaatgagtcgcac

SEQ ID NO: 2868 - DNA, 24 bp, Artificial Sequence
  Description of Artificial Sequence: Synthetic oligonucleotide
gggtgactcattaatgagtcaccc

SEQ ID NO: 2869 - DNA, 24 bp, Artificial Sequence
  Description of Artificial Sequence: Synthetic oligonucleotide
acgggactcattaatgagtcccgt

SEQ ID NO: 2870 - DNA, 24 bp, Artificial Sequence
  Description of Artificial Sequence: Synthetic oligonucleotide
cagggactcattaatgagtccctg

SEQ ID NO: 2871 - DNA, 24 bp, Artificial Sequence
  Description of Artificial Sequence: Synthetic oligonucleotide
ccaggactcattaatgagtcctgg

SEQ ID NO: 2872 - DNA, 24 bp, Artificial Sequence
  Description of Artificial Sequence: Synthetic oligonucleotide
ccgagactcattaatgagtctcgg

SEQ ID NO: 2873 - DNA, 24 bp, Artificial Sequence
  Description of Artificial Sequence: Synthetic oligonucleotide
tcgggactcattaatgagtcccga

SEQ ID NO: 2874 - DNA, 24 bp, Artificial Sequence
  Description of Artificial Sequence: Synthetic oligonucleotide
ctgggactcattaatgagtcccag

SEQ ID NO: 2875 - DNA, 24 bp, Artificial Sequence
  Description of Artificial Sequence: Synthetic oligonucleotide
cctggactcattaatgagtccagg

SEQ ID NO: 2876 - DNA, 24 bp, Artificial Sequence
  Description of Artificial Sequence: Synthetic oligonucleotide
ccgtgactcattaatgagtcacgg

SEQ ID NO: 2877 - DNA, 24 bp, Artificial Sequence
  Description of Artificial Sequence: Synthetic oligonucleotide
cggcgactcattaatgagtcgccg

SEQ ID NO: 2878 - DNA, 24 bp, Artificial Sequence
  Description of Artificial Sequence: Synthetic oligonucleotide
cagcgactcattaatgagtcgctg

SEQ ID NO: 2879 - DNA, 24 bp, Artificial Sequence
  Description of Artificial Sequence: Synthetic oligonucleotide
cgacgactcattaatgagtcgtcg

SEQ ID NO: 2880 - DNA, 24 bp, Artificial Sequence
  Description of Artificial Sequence: Synthetic oligonucleotide
cggagactcattaatgagtctccg

SEQ ID NO: 2881 - DNA, 24 bp, Artificial Sequence
  Description of Artificial Sequence: Synthetic oligonucleotide
ctgcgactcattaatgagtcgcag

SEQ ID NO: 2882 - DNA, 24 bp, Artificial Sequence
  Description of Artificial Sequence: Synthetic oligonucleotide
cggtgactcattaatgagtcaccg

SEQ ID NO: 2883 - DNA, 24 bp, Artificial Sequence
  Description of Artificial Sequence: Synthetic oligonucleotide
cacggactcattaatgagtccgtg

SEQ ID NO: 2884 - DNA, 24 bp, Artificial Sequence
  Description of Artificial Sequence: Synthetic oligonucleotide
cccagactcattaatgagtctggg

SEQ ID NO: 2885 - DNA, 24 bp, Artificial Sequence
  Description of Artificial Sequence: Synthetic oligonucleotide
ctcggactcattaatgagtccgag

SEQ ID NO: 2886 - DNA, 24 bp, Artificial Sequence
  Description of Artificial Sequence: Synthetic oligonucleotide
ccctgactcattaatgagtcaggg

SEQ ID NO: 2887 - DNA, 24 bp, Artificial Sequence
  Description of Artificial Sequence: Synthetic oligonucleotide
ccacgactcattaatgagtcgtgg

SEQ ID NO: 2888 - DNA, 24 bp, Artificial Sequence
  Description of Artificial Sequence: Synthetic oligonucleotide
agccgactcattaatgagtcggct

SEQ ID NO: 2889 - DNA, 24 bp, Artificial Sequence
  Description of Artificial Sequence: Synthetic oligonucleotide
tgccgactcattaatgagtcggca

SEQ ID NO: 2890 - DNA, 24 bp, Artificial Sequence
  Description of Artificial Sequence: Synthetic oligonucleotide
gcgagactcattaatgagtctcgc

SEQ ID NO: 2891 - DNA, 24 bp, Artificial Sequence
  Description of Artificial Sequence: Synthetic oligonucleotide
gcgtgactcattaatgagtcacgc

SEQ ID NO: 2892 - DNA, 24 bp, Artificial Sequence
  Description of Artificial Sequence: Synthetic oligonucleotide
gcaggactcattaatgagtcctgc

SEQ ID NO: 2893 - DNA, 24 bp, Artificial Sequence
  Description of Artificial Sequence: Synthetic oligonucleotide
gctggactcattaatgagtccagc

SEQ ID NO: 2894 - DNA, 24 bp, Artificial Sequence
  Description of Artificial Sequence: Synthetic oligonucleotide
cgaggactcattaatgagtcctcg

SEQ ID NO: 2895 - DNA, 24 bp, Artificial Sequence
  Description of Artificial Sequence: Synthetic oligonucleotide
cgtggactcattaatgagtccacg

SEQ ID NO: 2896 - DNA, 24 bp, Artificial Sequence
  Description of Artificial Sequence: Synthetic oligonucleotide
caccgactcattaatgagtcggtg

SEQ ID NO: 2897 - DNA, 24 bp, Artificial Sequence
  Description of Artificial Sequence: Synthetic oligonucleotide
ctccgactcattaatgagtcggag

SEQ ID NO: 2898 - DNA, 24 bp, Artificial Sequence
  Description of Artificial Sequence: Synthetic oligonucleotide
gcgggactcattaatgagtcccgc

SEQ ID NO: 2899 - DNA, 24 bp, Artificial Sequence
  Description of Artificial Sequence: Synthetic oligonucleotide
gagggactcattaatgagtccctc

SEQ ID NO: 2900 - DNA, 24 bp, Artificial Sequence
  Description of Artificial Sequence: Synthetic oligonucleotide
gtgggactcattaatgagtcccac

SEQ ID NO: 2901 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcatgcatgagtcnnnn

SEQ ID NO: 2902 - DNA, 24 bp, Artificial Sequence
  Description of Artificial Sequence: Synthetic oligonucleotide
ggcggactcatgcatgagtccgcc

SEQ ID NO: 2903 - DNA, 24 bp, Artificial Sequence
  Description of Artificial Sequence: Synthetic oligonucleotide
agcggactcatgcatgagtccgct

SEQ ID NO: 2904 - DNA, 24 bp, Artificial Sequence
  Description of Artificial Sequence: Synthetic oligonucleotide
gacggactcatgcatgagtccgtc

SEQ ID NO: 2905 - DNA, 24 bp, Artificial Sequence
  Description of Artificial Sequence: Synthetic oligonucleotide
ggaggactcatgcatgagtcctcc

SEQ ID NO: 2906 - DNA, 24 bp, Artificial Sequence
  Description of Artificial Sequence: Synthetic oligonucleotide
ggcagactcatgcatgagtctgcc

SEQ ID NO: 2907 - DNA, 24 bp, Artificial Sequence
  Description of Artificial Sequence: Synthetic oligonucleotide
tgcggactcatgcatgagtccgca

SEQ ID NO: 2908 - DNA, 24 bp, Artificial Sequence
  Description of Artificial Sequence: Synthetic oligonucleotide
gtcggactcatgcatgagtccgac

SEQ ID NO: 2909 - DNA, 24 bp, Artificial Sequence
  Description of Artificial Sequence: Synthetic oligonucleotide
ggtggactcatgcatgagtccacc

SEQ ID NO: 2910 - DNA, 24 bp, Artificial Sequence
  Description of Artificial Sequence: Synthetic oligonucleotide
ggctgactcatgcatgagtcagcc

SEQ ID NO: 2911 - DNA, 24 bp, Artificial Sequence
  Description of Artificial Sequence: Synthetic oligonucleotide
gcccgactcatgcatgagtcgggc

SEQ ID NO: 2912 - DNA, 24 bp, Artificial Sequence
  Description of Artificial Sequence: Synthetic oligonucleotide
acccgactcatgcatgagtcgggt

SEQ ID NO: 2913 - DNA, 24 bp, Artificial Sequence
  Description of Artificial Sequence: Synthetic oligonucleotide
gaccgactcatgcatgagtcggtc

SEQ ID NO: 2914 - DNA, 24 bp, Artificial Sequence
  Description of Artificial Sequence: Synthetic oligonucleotide
gcacgactcatgcatgagtcgtgc

SEQ ID NO: 2915 - DNA, 24 bp, Artificial Sequence
  Description of Artificial Sequence: Synthetic oligonucleotide
gccagactcatgcatgagtctggc

SEQ ID NO: 2916 - DNA, 24 bp, Artificial Sequence
  Description of Artificial Sequence: Synthetic oligonucleotide
tcccgactcatgcatgagtcggga

SEQ ID NO: 2917 - DNA, 24 bp, Artificial Sequence
  Description of Artificial Sequence: Synthetic oligonucleotide
gtccgactcatgcatgagtcggac

SEQ ID NO: 2918 - DNA, 24 bp, Artificial Sequence
  Description of Artificial Sequence: Synthetic oligonucleotide
gcctgactcatgcatgagtcaggc

SEQ ID NO: 2919 - DNA, 24 bp, Artificial Sequence
  Description of Artificial Sequence: Synthetic oligonucleotide
gggcgactcatgcatgagtcgccc

SEQ ID NO: 2920 - DNA, 24 bp, Artificial Sequence
  Description of Artificial Sequence: Synthetic oligonucleotide
aggcgactcatgcatgagtcgcct

SEQ ID NO: 2921 - DNA, 24 bp, Artificial Sequence
  Description of Artificial Sequence: Synthetic oligonucleotide
gagcgactcatgcatgagtcgctc

SEQ ID NO: 2922 - DNA, 24 bp, Artificial Sequence
  Description of Artificial Sequence: Synthetic oligonucleotide
ggacgactcatgcatgagtcgtcc

SEQ ID NO: 2923 - DNA, 24 bp, Artificial Sequence
  Description of Artificial Sequence: Synthetic oligonucleotide
gggagactcatgcatgagtctccc

SEQ ID NO: 2924 - DNA, 24 bp, Artificial Sequence
  Description of Artificial Sequence: Synthetic oligonucleotide
tggcgactcatgcatgagtcgcca

SEQ ID NO: 2925 - DNA, 24 bp, Artificial Sequence
  Description of Artificial Sequence: Synthetic oligonucleotide
gtgcgactcatgcatgagtcgcac

SEQ ID NO: 2926 - DNA, 24 bp, Artificial Sequence
  Description of Artificial Sequence: Synthetic oligonucleotide
gggtgactcatgcatgagtcaccc

SEQ ID NO: 2927 - DNA, 24 bp, Artificial Sequence
  Description of Artificial Sequence: Synthetic oligonucleotide
acgggactcatgcatgagtcccgt

SEQ ID NO: 2928 - DNA, 24 bp, Artificial Sequence
  Description of Artificial Sequence: Synthetic oligonucleotide
cagggactcatgcatgagtccctg

SEQ ID NO: 2929 - DNA, 24 bp, Artificial Sequence
  Description of Artificial Sequence: Synthetic oligonucleotide
ccaggactcatgcatgagtcctgg

SEQ ID NO: 2930 - DNA, 24 bp, Artificial Sequence
  Description of Artificial Sequence: Synthetic oligonucleotide
ccgagactcatgcatgagtctcgg

SEQ ID NO: 2931 - DNA, 24 bp, Artificial Sequence
  Description of Artificial Sequence: Synthetic oligonucleotide
tcgggactcatgcatgagtcccga

SEQ ID NO: 2932 - DNA, 24 bp, Artificial Sequence
  Description of Artificial Sequence: Synthetic oligonucleotide
ctgggactcatgcatgagtcccag

SEQ ID NO: 2933 - DNA, 24 bp, Artificial Sequence
  Description of Artificial Sequence: Synthetic oligonucleotide
cctggactcatgcatgagtccagg

SEQ ID NO: 2934 - DNA, 24 bp, Artificial Sequence
  Description of Artificial Sequence: Synthetic oligonucleotide
ccgtgactcatgcatgagtcacgg

SEQ ID NO: 2935 - DNA, 24 bp, Artificial Sequence
  Description of Artificial Sequence: Synthetic oligonucleotide
cggcgactcatgcatgagtcgccg

SEQ ID NO: 2936 - DNA, 24 bp, Artificial Sequence
  Description of Artificial Sequence: Synthetic oligonucleotide
cagcgactcatgcatgagtcgctg

SEQ ID NO: 2937 - DNA, 24 bp, Artificial Sequence
  Description of Artificial Sequence: Synthetic oligonucleotide
cgacgactcatgcatgagtcgtcg

SEQ ID NO: 2938 - DNA, 24 bp, Artificial Sequence
  Description of Artificial Sequence: Synthetic oligonucleotide
cggagactcatgcatgagtctccg

SEQ ID NO: 2939 - DNA, 24 bp, Artificial Sequence
  Description of Artificial Sequence: Synthetic oligonucleotide
ctgcgactcatgcatgagtcgcag

SEQ ID NO: 2940 - DNA, 24 bp, Artificial Sequence
  Description of Artificial Sequence: Synthetic oligonucleotide
cggtgactcatgcatgagtcaccg

SEQ ID NO: 2941 - DNA, 24 bp, Artificial Sequence
  Description of Artificial Sequence: Synthetic oligonucleotide
cacggactcatgcatgagtccgtg

SEQ ID NO: 2942 - DNA, 24 bp, Artificial Sequence
  Description of Artificial Sequence: Synthetic oligonucleotide
cccagactcatgcatgagtctggg

SEQ ID NO: 2943 - DNA, 24 bp, Artificial Sequence
  Description of Artificial Sequence: Synthetic oligonucleotide
ctcggactcatgcatgagtccgag

SEQ ID NO: 2944 - DNA, 24 bp, Artificial Sequence
  Description of Artificial Sequence: Synthetic oligonucleotide
ccctgactcatgcatgagtcaggg

SEQ ID NO: 2945 - DNA, 24 bp, Artificial Sequence
  Description of Artificial Sequence: Synthetic oligonucleotide
ccacgactcatgcatgagtcgtgg

SEQ ID NO: 2946 - DNA, 24 bp, Artificial Sequence
  Description of Artificial Sequence: Synthetic oligonucleotide
agccgactcatgcatgagtcggct

SEQ ID NO: 2947 - DNA, 24 bp, Artificial Sequence
  Description of Artificial Sequence: Synthetic oligonucleotide
tgccgactcatgcatgagtcggca

SEQ ID NO: 2948 - DNA, 24 bp, Artificial Sequence
  Description of Artificial Sequence: Synthetic oligonucleotide
gcgagactcatgcatgagtctcgc

SEQ ID NO: 2949 - DNA, 24 bp, Artificial Sequence
  Description of Artificial Sequence: Synthetic oligonucleotide
gcgtgactcatgcatgagtcacgc

SEQ ID NO: 2950 - DNA, 24 bp, Artificial Sequence
  Description of Artificial Sequence: Synthetic oligonucleotide
gcaggactcatgcatgagtcctgc

SEQ ID NO: 2951 - DNA, 24 bp, Artificial Sequence
  Description of Artificial Sequence: Synthetic oligonucleotide
gctggactcatgcatgagtccagc

SEQ ID NO: 2952 - DNA, 24 bp, Artificial Sequence
  Description of Artificial Sequence: Synthetic oligonucleotide
cgaggactcatgcatgagtcctcg

SEQ ID NO: 2953 - DNA, 24 bp, Artificial Sequence
  Description of Artificial Sequence: Synthetic oligonucleotide
cgtggactcatgcatgagtccacg

SEQ ID NO: 2954 - DNA, 24 bp, Artificial Sequence
  Description of Artificial Sequence: Synthetic oligonucleotide
caccgactcatgcatgagtcggtg

SEQ ID NO: 2955 - DNA, 24 bp, Artificial Sequence
  Description of Artificial Sequence: Synthetic oligonucleotide
ctccgactcatgcatgagtcggag

SEQ ID NO: 2956 - DNA, 24 bp, Artificial Sequence
  Description of Artificial Sequence: Synthetic oligonucleotide
gcgggactcatgcatgagtcccgc

SEQ ID NO: 2957 - DNA, 24 bp, Artificial Sequence
  Description of Artificial Sequence: Synthetic oligonucleotide
gagggactcatgcatgagtccctc

SEQ ID NO: 2958 - DNA, 24 bp, Artificial Sequence
  Description of Artificial Sequence: Synthetic oligonucleotide
gtgggactcatgcatgagtcccac

SEQ ID NO: 2959 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcatcgatgagtcnnnn

SEQ ID NO: 2960 - DNA, 24 bp, Artificial Sequence
  Description of Artificial Sequence: Synthetic oligonucleotide
ggcggactcatcgatgagtccgcc

SEQ ID NO: 2961 - DNA, 24 bp, Artificial Sequence
  Description of Artificial Sequence: Synthetic oligonucleotide
agcggactcatcgatgagtccgct

SEQ ID NO: 2962 - DNA, 24 bp, Artificial Sequence
  Description of Artificial Sequence: Synthetic oligonucleotide
gacggactcatcgatgagtccgtc

SEQ ID NO: 2963 - DNA, 24 bp, Artificial Sequence
  Description of Artificial Sequence: Synthetic oligonucleotide
ggaggactcatcgatgagtcctcc

SEQ ID NO: 2964 - DNA, 24 bp, Artificial Sequence
  Description of Artificial Sequence: Synthetic oligonucleotide
ggcagactcatcgatgagtctgcc

SEQ ID NO: 2965 - DNA, 24 bp, Artificial Sequence
  Description of Artificial Sequence: Synthetic oligonucleotide
tgcggactcatcgatgagtccgca

SEQ ID NO: 2966 - DNA, 24 bp, Artificial Sequence
  Description of Artificial Sequence: Synthetic oligonucleotide
gtcggactcatcgatgagtccgac

SEQ ID NO: 2967 - DNA, 24 bp, Artificial Sequence
  Description of Artificial Sequence: Synthetic oligonucleotide
ggtggactcatcgatgagtccacc

SEQ ID NO: 2968 - DNA, 24 bp, Artificial Sequence
  Description of Artificial Sequence: Synthetic oligonucleotide
ggctgactcatcgatgagtcagcc

SEQ ID NO: 2969 - DNA, 24 bp, Artificial Sequence
  Description of Artificial Sequence: Synthetic oligonucleotide
gcccgactcatcgatgagtcgggc

SEQ ID NO: 2970 - DNA, 24 bp, Artificial Sequence
  Description of Artificial Sequence: Synthetic oligonucleotide
acccgactcatcgatgagtcgggt

SEQ ID NO: 2971 - DNA, 24 bp, Artificial Sequence
  Description of Artificial Sequence: Synthetic oligonucleotide
gaccgactcatcgatgagtcggtc

SEQ ID NO: 2972 - DNA, 24 bp, Artificial Sequence
  Description of Artificial Sequence: Synthetic oligonucleotide
gcacgactcatcgatgagtcgtgc

SEQ ID NO: 2973 - DNA, 24 bp, Artificial Sequence
  Description of Artificial Sequence: Synthetic oligonucleotide
gccagactcatcgatgagtctggc

SEQ ID NO: 2974 - DNA, 24 bp, Artificial Sequence
  Description of Artificial Sequence: Synthetic oligonucleotide
tcccgactcatcgatgagtcggga

SEQ ID NO: 2975 - DNA, 24 bp, Artificial Sequence
  Description of Artificial Sequence: Synthetic oligonucleotide
gtccgactcatcgatgagtcggac

SEQ ID NO: 2976 - DNA, 24 bp, Artificial Sequence
  Description of Artificial Sequence: Synthetic oligonucleotide
gcctgactcatcgatgagtcaggc

SEQ ID NO: 2977 - DNA, 24 bp, Artificial Sequence
  Description of Artificial Sequence: Synthetic oligonucleotide
gggcgactcatcgatgagtcgccc

SEQ ID NO: 2978 - DNA, 24 bp, Artificial Sequence
  Description of Artificial Sequence: Synthetic oligonucleotide
aggcgactcatcgatgagtcgcct

SEQ ID NO: 2979 - DNA, 24 bp, Artificial Sequence
  Description of Artificial Sequence: Synthetic oligonucleotide
gagcgactcatcgatgagtcgctc

SEQ ID NO: 2980 - DNA, 24 bp, Artificial Sequence
  Description of Artificial Sequence: Synthetic oligonucleotide
ggacgactcatcgatgagtcgtcc

SEQ ID NO: 2981 - DNA, 24 bp, Artificial Sequence
  Description of Artificial Sequence: Synthetic oligonucleotide
gggagactcatcgatgagtctccc

SEQ ID NO: 2982 - DNA, 24 bp, Artificial Sequence
  Description of Artificial Sequence: Synthetic oligonucleotide
tggcgactcatcgatgagtcgcca

SEQ ID NO: 2983 - DNA, 24 bp, Artificial Sequence
  Description of Artificial Sequence: Synthetic oligonucleotide
gtgcgactcatcgatgagtcgcac

SEQ ID NO: 2984 - DNA, 24 bp, Artificial Sequence
  Description of Artificial Sequence: Synthetic oligonucleotide
gggtgactcatcgatgagtcaccc

SEQ ID NO: 2985 - DNA, 24 bp, Artificial Sequence
  Description of Artificial Sequence: Synthetic oligonucleotide
acgggactcatcgatgagtcccgt

SEQ ID NO: 2986 - DNA, 24 bp, Artificial Sequence
  Description of Artificial Sequence: Synthetic oligonucleotide
cagggactcatcgatgagtccctg

SEQ ID NO: 2987 - DNA, 24 bp, Artificial Sequence
  Description of Artificial Sequence: Synthetic oligonucleotide
ccaggactcatcgatgagtcctgg

SEQ ID NO: 2988 - DNA, 24 bp, Artificial Sequence
  Description of Artificial Sequence: Synthetic oligonucleotide
ccgagactcatcgatgagtctcgg

SEQ ID NO: 2989 - DNA, 24 bp, Artificial Sequence
  Description of Artificial Sequence: Synthetic oligonucleotide
tcgggactcatcgatgagtcccga

SEQ ID NO: 2990 - DNA, 24 bp, Artificial Sequence
  Description of Artificial Sequence: Synthetic oligonucleotide
ctgggactcatcgatgagtcccag

SEQ ID NO: 2991 - DNA, 24 bp, Artificial Sequence
  Description of Artificial Sequence: Synthetic oligonucleotide
cctggactcatcgatgagtccagg

SEQ ID NO: 2992 - DNA, 24 bp, Artificial Sequence
  Description of Artificial Sequence: Synthetic oligonucleotide
ccgtgactcatcgatgagtcacgg

SEQ ID NO: 2993 - DNA, 24 bp, Artificial Sequence
  Description of Artificial Sequence: Synthetic oligonucleotide
cggcgactcatcgatgagtcgccg

SEQ ID NO: 2994 - DNA, 24 bp, Artificial Sequence
  Description of Artificial Sequence: Synthetic oligonucleotide
cagcgactcatcgatgagtcgctg

SEQ ID NO: 2995 - DNA, 24 bp, Artificial Sequence
  Description of Artificial Sequence: Synthetic oligonucleotide
cgacgactcatcgatgagtcgtcg

SEQ ID NO: 2996 - DNA, 24 bp, Artificial Sequence
  Description of Artificial Sequence: Synthetic oligonucleotide
cggagactcatcgatgagtctccg

SEQ ID NO: 2997 - DNA, 24 bp, Artificial Sequence
  Description of Artificial Sequence: Synthetic oligonucleotide
ctgcgactcatcgatgagtcgcag

SEQ ID NO: 2998 - DNA, 24 bp, Artificial Sequence
  Description of Artificial Sequence: Synthetic oligonucleotide
cggtgactcatcgatgagtcaccg

SEQ ID NO: 2999 - DNA, 24 bp, Artificial Sequence
  Description of Artificial Sequence: Synthetic oligonucleotide
cacggactcatcgatgagtccgtg

SEQ ID NO: 3000 - DNA, 24 bp, Artificial Sequence
  Description of Artificial Sequence: Synthetic oligonucleotide
cccagactcatcgatgagtctggg

SEQ ID NO: 3001 - DNA, 24 bp, Artificial Sequence
  Description of Artificial Sequence: Synthetic oligonucleotide
ctcggactcatcgatgagtccgag

SEQ ID NO: 3002 - DNA, 24 bp, Artificial Sequence
  Description of Artificial Sequence: Synthetic oligonucleotide
ccctgactcatcgatgagtcaggg

SEQ ID NO: 3003 - DNA, 24 bp, Artificial Sequence
  Description of Artificial Sequence: Synthetic oligonucleotide
ccacgactcatcgatgagtcgtgg

SEQ ID NO: 3004 - DNA, 24 bp, Artificial Sequence
  Description of Artificial Sequence: Synthetic oligonucleotide
agccgactcatcgatgagtcggct

SEQ ID NO: 3005 - DNA, 24 bp, Artificial Sequence
  Description of Artificial Sequence: Synthetic oligonucleotide
tgccgactcatcgatgagtcggca

SEQ ID NO: 3006 - DNA, 24 bp, Artificial Sequence
  Description of Artificial Sequence: Synthetic oligonucleotide
gcgagactcatcgatgagtctcgc

SEQ ID NO: 3007 - DNA, 24 bp, Artificial Sequence
  Description of Artificial Sequence: Synthetic oligonucleotide
gcgtgactcatcgatgagtcacgc

SEQ ID NO: 3008 - DNA, 24 bp, Artificial Sequence
  Description of Artificial Sequence: Synthetic oligonucleotide
gcaggactcatcgatgagtcctgc

SEQ ID NO: 3009 - DNA, 24 bp, Artificial Sequence
  Description of Artificial Sequence: Synthetic oligonucleotide
gctggactcatcgatgagtccagc

SEQ ID NO: 3010 - DNA, 24 bp, Artificial Sequence
  Description of Artificial Sequence: Synthetic oligonucleotide
cgaggactcatcgatgagtcctcg

SEQ ID NO: 3011 - DNA, 24 bp, Artificial Sequence
  Description of Artificial Sequence: Synthetic oligonucleotide
cgtggactcatcgatgagtccacg

SEQ ID NO: 3012 - DNA, 24 bp, Artificial Sequence
  Description of Artificial Sequence: Synthetic oligonucleotide
caccgactcatcgatgagtcggtg

SEQ ID NO: 3013 - DNA, 24 bp, Artificial Sequence
  Description of Artificial Sequence: Synthetic oligonucleotide
ctccgactcatcgatgagtcggag

SEQ ID NO: 3014 - DNA, 24 bp, Artificial Sequence
  Description of Artificial Sequence: Synthetic oligonucleotide
gcgggactcatcgatgagtcccgc

SEQ ID NO: 3015 - DNA, 24 bp, Artificial Sequence
  Description of Artificial Sequence: Synthetic oligonucleotide
gagggactcatcgatgagtccctc

SEQ ID NO: 3016 - DNA, 24 bp, Artificial Sequence
  Description of Artificial Sequence: Synthetic oligonucleotide
gtgggactcatcgatgagtcccac

SEQ ID NO: 3017 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcttataagagtcnnnn

SEQ ID NO: 3018 - DNA, 24 bp, Artificial Sequence
  Description of Artificial Sequence: Synthetic oligonucleotide
ggcggactcttataagagtccgcc

SEQ ID NO: 3019 - DNA, 24 bp, Artificial Sequence
  Description of Artificial Sequence: Synthetic oligonucleotide
agcggactcttataagagtccgct

SEQ ID NO: 3020 - DNA, 24 bp, Artificial Sequence
  Description of Artificial Sequence: Synthetic oligonucleotide
gacggactcttataagagtccgtc

SEQ ID NO: 3021 - DNA, 24 bp, Artificial Sequence
  Description of Artificial Sequence: Synthetic oligonucleotide
ggaggactcttataagagtcctcc

SEQ ID NO: 3022 - DNA, 24 bp, Artificial Sequence
  Description of Artificial Sequence: Synthetic oligonucleotide
ggcagactcttataagagtctgcc

SEQ ID NO: 3023 - DNA, 24 bp, Artificial Sequence
  Description of Artificial Sequence: Synthetic oligonucleotide
tgcggactcttataagagtccgca

SEQ ID NO: 3024 - DNA, 24 bp, Artificial Sequence
  Description of Artificial Sequence: Synthetic oligonucleotide
gtcggactcttataagagtccgac

SEQ ID NO: 3025 - DNA, 24 bp, Artificial Sequence
  Description of Artificial Sequence: Synthetic oligonucleotide
ggtggactcttataagagtccacc

SEQ ID NO: 3026 - DNA, 24 bp, Artificial Sequence
  Description of Artificial Sequence: Synthetic oligonucleotide
ggctgactcttataagagtcagcc

SEQ ID NO: 3027 - DNA, 24 bp, Artificial Sequence
  Description of Artificial Sequence: Synthetic oligonucleotide
gcccgactcttataagagtcgggc

SEQ ID NO: 3028 - DNA, 24 bp, Artificial Sequence
  Description of Artificial Sequence: Synthetic oligonucleotide
acccgactcttataagagtcgggt

SEQ ID NO: 3029 - DNA, 24 bp, Artificial Sequence
  Description of Artificial Sequence: Synthetic oligonucleotide
gaccgactcttataagagtcggtc

SEQ ID NO: 3030 - DNA, 24 bp, Artificial Sequence
  Description of Artificial Sequence: Synthetic oligonucleotide
gcacgactcttataagagtcgtgc

SEQ ID NO: 3031 - DNA, 24 bp, Artificial Sequence
  Description of Artificial Sequence: Synthetic oligonucleotide
gccagactcttataagagtctggc

SEQ ID NO: 3032 - DNA, 24 bp, Artificial Sequence
  Description of Artificial Sequence: Synthetic oligonucleotide
tcccgactcttataagagtcggga

SEQ ID NO: 3033 - DNA, 24 bp, Artificial Sequence
  Description of Artificial Sequence: Synthetic oligonucleotide
gtccgactcttataagagtcggac

SEQ ID NO: 3034 - DNA, 24 bp, Artificial Sequence
  Description of Artificial Sequence: Synthetic oligonucleotide
gcctgactcttataagagtcaggc

SEQ ID NO: 3035 - DNA, 24 bp, Artificial Sequence
  Description of Artificial Sequence: Synthetic oligonucleotide
gggcgactcttataagagtcgccc

SEQ ID NO: 3036 - DNA, 24 bp, Artificial Sequence
  Description of Artificial Sequence: Synthetic oligonucleotide
aggcgactcttataagagtcgcct

SEQ ID NO: 3037 - DNA, 24 bp, Artificial Sequence
  Description of Artificial Sequence: Synthetic oligonucleotide
gagcgactcttataagagtcgctc

SEQ ID NO: 3038 - DNA, 24 bp, Artificial Sequence
  Description of Artificial Sequence: Synthetic oligonucleotide
ggacgactcttataagagtcgtcc

SEQ ID NO: 3039 - DNA, 24 bp, Artificial Sequence
  Description of Artificial Sequence: Synthetic oligonucleotide
gggagactcttataagagtctccc

SEQ ID NO: 3040 - DNA, 24 bp, Artificial Sequence
  Description of Artificial Sequence: Synthetic oligonucleotide
tggcgactcttataagagtcgcca

SEQ ID NO: 3041 - DNA, 24 bp, Artificial Sequence
  Description of Artificial Sequence: Synthetic oligonucleotide
gtgcgactcttataagagtcgcac

SEQ ID NO: 3042 - DNA, 24 bp, Artificial Sequence
  Description of Artificial Sequence: Synthetic oligonucleotide
gggtgactcttataagagtcaccc

SEQ ID NO: 3043 - DNA, 24 bp, Artificial Sequence
  Description of Artificial Sequence: Synthetic oligonucleotide
acgggactcttataagagtcccgt

SEQ ID NO: 3044 - DNA, 24 bp, Artificial Sequence
  Description of Artificial Sequence: Synthetic oligonucleotide
cagggactcttataagagtccctg

SEQ ID NO: 3045 - DNA, 24 bp, Artificial Sequence
  Description of Artificial Sequence: Synthetic oligonucleotide
ccaggactcttataagagtcctgg

SEQ ID NO: 3046 - DNA, 24 bp, Artificial Sequence
  Description of Artificial Sequence: Synthetic oligonucleotide
ccgagactcttataagagtctcgg

SEQ ID NO: 3047 - DNA, 24 bp, Artificial Sequence
  Description of Artificial Sequence: Synthetic oligonucleotide
tcgggactcttataagagtcccga

SEQ ID NO: 3048 - DNA, 24 bp, Artificial Sequence
  Description of Artificial Sequence: Synthetic oligonucleotide
ctgggactcttataagagtcccag

SEQ ID NO: 3049 - DNA, 24 bp, Artificial Sequence
  Description of Artificial Sequence: Synthetic oligonucleotide
cctggactcttataagagtccagg

SEQ ID NO: 3050 - DNA, 24 bp, Artificial Sequence
  Description of Artificial Sequence: Synthetic oligonucleotide
ccgtgactcttataagagtcacgg

SEQ ID NO: 3051 - DNA, 24 bp, Artificial Sequence
  Description of Artificial Sequence: Synthetic oligonucleotide
cggcgactcttataagagtcgccg

SEQ ID NO: 3052 - DNA, 24 bp, Artificial Sequence
  Description of Artificial Sequence: Synthetic oligonucleotide
cagcgactcttataagagtcgctg

SEQ ID NO: 3053 - DNA, 24 bp, Artificial Sequence
  Description of Artificial Sequence: Synthetic oligonucleotide
cgacgactcttataagagtcgtcg

SEQ ID NO: 3054 - DNA, 24 bp, Artificial Sequence
  Description of Artificial Sequence: Synthetic oligonucleotide
cggagactcttataagagtctccg

SEQ ID NO: 3055 - DNA, 24 bp, Artificial Sequence
  Description of Artificial Sequence: Synthetic oligonucleotide
ctgcgactcttataagagtcgcag

SEQ ID NO: 3056 - DNA, 24 bp, Artificial Sequence
  Description of Artificial Sequence: Synthetic oligonucleotide
cggtgactcttataagagtcaccg

SEQ ID NO: 3057 - DNA, 24 bp, Artificial Sequence
  Description of Artificial Sequence: Synthetic oligonucleotide
cacggactcttataagagtccgtg

SEQ ID NO: 3058 - DNA, 24 bp, Artificial Sequence
  Description of Artificial Sequence: Synthetic oligonucleotide
cccagactcttataagagtctggg

SEQ ID NO: 3059 - DNA, 24 bp, Artificial Sequence
  Description of Artificial Sequence: Synthetic oligonucleotide
ctcggactcttataagagtccgag

SEQ ID NO: 3060 - DNA, 24 bp, Artificial Sequence
  Description of Artificial Sequence: Synthetic oligonucleotide
ccctgactcttataagagtcaggg

SEQ ID NO: 3061 - DNA, 24 bp, Artificial Sequence
  Description of Artificial Sequence: Synthetic oligonucleotide
ccacgactcttataagagtcgtgg

SEQ ID NO: 3062 - DNA, 24 bp, Artificial Sequence
  Description of Artificial Sequence: Synthetic oligonucleotide
agccgactcttataagagtcggct

SEQ ID NO: 3063 - DNA, 24 bp, Artificial Sequence
  Description of Artificial Sequence: Synthetic oligonucleotide
tgccgactcttataagagtcggca

SEQ ID NO: 3064 - DNA, 24 bp, Artificial Sequence
  Description of Artificial Sequence: Synthetic oligonucleotide
gcgagactcttataagagtctcgc

SEQ ID NO: 3065 - DNA, 24 bp, Artificial Sequence
  Description of Artificial Sequence: Synthetic oligonucleotide
gcgtgactcttataagagtcacgc

SEQ ID NO: 3066 - DNA, 24 bp, Artificial Sequence
  Description of Artificial Sequence: Synthetic oligonucleotide
gcaggactcttataagagtcctgc

SEQ ID NO: 3067 - DNA, 24 bp, Artificial Sequence
  Description of Artificial Sequence: Synthetic oligonucleotide
gctggactcttataagagtccagc

SEQ ID NO: 3068 - DNA, 24 bp, Artificial Sequence
  Description of Artificial Sequence: Synthetic oligonucleotide
cgaggactcttataagagtcctcg

SEQ ID NO: 3069 - DNA, 24 bp, Artificial Sequence
  Description of Artificial Sequence: Synthetic oligonucleotide
cgtggactcttataagagtccacg

SEQ ID NO: 3070 - DNA, 24 bp, Artificial Sequence
  Description of Artificial Sequence: Synthetic oligonucleotide
caccgactcttataagagtcggtg

SEQ ID NO: 3071 - DNA, 24 bp, Artificial Sequence
  Description of Artificial Sequence: Synthetic oligonucleotide
ctccgactcttataagagtcggag

SEQ ID NO: 3072 - DNA, 24 bp, Artificial Sequence
  Description of Artificial Sequence: Synthetic oligonucleotide
gcgggactcttataagagtcccgc

SEQ ID NO: 3073 - DNA, 24 bp, Artificial Sequence
  Description of Artificial Sequence: Synthetic oligonucleotide
gagggactcttataagagtccctc

SEQ ID NO: 3074 - DNA, 24 bp, Artificial Sequence
  Description of Artificial Sequence: Synthetic oligonucleotide
gtgggactcttataagagtcccac

SEQ ID NO: 3075 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactctttaaagagtcnnnn

SEQ ID NO: 3076 - DNA, 24 bp, Artificial Sequence
  Description of Artificial Sequence: Synthetic oligonucleotide
ggcggactctttaaagagtccgcc

SEQ ID NO: 3077 - DNA, 24 bp, Artificial Sequence
  Description of Artificial Sequence: Synthetic oligonucleotide
agcggactctttaaagagtccgct

SEQ ID NO: 3078 - DNA, 24 bp, Artificial Sequence
  Description of Artificial Sequence: Synthetic oligonucleotide
gacggactctttaaagagtccgtc

SEQ ID NO: 3079 - DNA, 24 bp, Artificial Sequence
  Description of Artificial Sequence: Synthetic oligonucleotide
ggaggactctttaaagagtcctcc

SEQ ID NO: 3080 - DNA, 24 bp, Artificial Sequence
  Description of Artificial Sequence: Synthetic oligonucleotide
ggcagactctttaaagagtctgcc

SEQ ID NO: 3081 - DNA, 24 bp, Artificial Sequence
  Description of Artificial Sequence: Synthetic oligonucleotide
tgcggactctttaaagagtccgca

SEQ ID NO: 3082 - DNA, 24 bp, Artificial Sequence
  Description of Artificial Sequence: Synthetic oligonucleotide
gtcggactctttaaagagtccgac

SEQ ID NO: 3083 - DNA, 24 bp, Artificial Sequence
  Description of Artificial Sequence: Synthetic oligonucleotide
ggtggactctttaaagagtccacc

SEQ ID NO: 3084 - DNA, 24 bp, Artificial Sequence
  Description of Artificial Sequence: Synthetic oligonucleotide
ggctgactctttaaagagtcagcc

SEQ ID NO: 3085 - DNA, 24 bp, Artificial Sequence
  Description of Artificial Sequence: Synthetic oligonucleotide
gcccgactctttaaagagtcgggc

SEQ ID NO: 3086 - DNA, 24 bp, Artificial Sequence
  Description of Artificial Sequence: Synthetic oligonucleotide
acccgactctttaaagagtcgggt

SEQ ID NO: 3087 - DNA, 24 bp, Artificial Sequence
  Description of Artificial Sequence: Synthetic oligonucleotide
gaccgactctttaaagagtcggtc

SEQ ID NO: 3088 - DNA, 24 bp, Artificial Sequence
  Description of Artificial Sequence: Synthetic oligonucleotide
gcacgactctttaaagagtcgtgc

SEQ ID NO: 3089 - DNA, 24 bp, Artificial Sequence
  Description of Artificial Sequence: Synthetic oligonucleotide
gccagactctttaaagagtctggc

SEQ ID NO: 3090 - DNA, 24 bp, Artificial Sequence
  Description of Artificial Sequence: Synthetic oligonucleotide
tcccgactctttaaagagtcggga

SEQ ID NO: 3091 - DNA, 24 bp, Artificial Sequence
  Description of Artificial Sequence: Synthetic oligonucleotide
gtccgactctttaaagagtcggac

SEQ ID NO: 3092 - DNA, 24 bp, Artificial Sequence
  Description of Artificial Sequence: Synthetic oligonucleotide
gcctgactctttaaagagtcaggc

SEQ ID NO: 3093 - DNA, 24 bp, Artificial Sequence
  Description of Artificial Sequence: Synthetic oligonucleotide
gggcgactctttaaagagtcgccc

SEQ ID NO: 3094 - DNA, 24 bp, Artificial Sequence
  Description of Artificial Sequence: Synthetic oligonucleotide
aggcgactctttaaagagtcgcct

SEQ ID NO: 3095 - DNA, 24 bp, Artificial Sequence
  Description of Artificial Sequence: Synthetic oligonucleotide
gagcgactctttaaagagtcgctc

SEQ ID NO: 3096 - DNA, 24 bp, Artificial Sequence
  Description of Artificial Sequence: Synthetic oligonucleotide
ggacgactctttaaagagtcgtcc

SEQ ID NO: 3097 - DNA, 24 bp, Artificial Sequence
  Description of Artificial Sequence: Synthetic oligonucleotide
gggagactctttaaagagtctccc

SEQ ID NO: 3098 - DNA, 24 bp, Artificial Sequence
  Description of Artificial Sequence: Synthetic oligonucleotide
tggcgactctttaaagagtcgcca

SEQ ID NO: 3099 - DNA, 24 bp, Artificial Sequence
  Description of Artificial Sequence: Synthetic oligonucleotide
gtgcgactctttaaagagtcgcac

SEQ ID NO: 3100 - DNA, 24 bp, Artificial Sequence
  Description of Artificial Sequence: Synthetic oligonucleotide
gggtgactctttaaagagtcaccc

SEQ ID NO: 3101 - DNA, 24 bp, Artificial Sequence
  Description of Artificial Sequence: Synthetic oligonucleotide
acgggactctttaaagagtcccgt

SEQ ID NO: 3102 - DNA, 24 bp, Artificial Sequence
  Description of Artificial Sequence: Synthetic oligonucleotide
cagggactctttaaagagtccctg

SEQ ID NO: 3103 - DNA, 24 bp, Artificial Sequence
  Description of Artificial Sequence: Synthetic oligonucleotide
ccaggactctttaaagagtcctgg

SEQ ID NO: 3104 - DNA, 24 bp, Artificial Sequence
  Description of Artificial Sequence: Synthetic oligonucleotide
ccgagactctttaaagagtctcgg

SEQ ID NO: 3105 - DNA, 24 bp, Artificial Sequence
  Description of Artificial Sequence: Synthetic oligonucleotide
tcgggactctttaaagagtcccga

SEQ ID NO: 3106 - DNA, 24 bp, Artificial Sequence
  Description of Artificial Sequence: Synthetic oligonucleotide
ctgggactctttaaagagtcccag

SEQ ID NO: 3107 - DNA, 24 bp, Artificial Sequence
  Description of Artificial Sequence: Synthetic oligonucleotide
cctggactctttaaagagtccagg

SEQ ID NO: 3108 - DNA, 24 bp, Artificial Sequence
  Description of Artificial Sequence: Synthetic oligonucleotide
ccgtgactctttaaagagtcacgg

SEQ ID NO: 3109 - DNA, 24 bp, Artificial Sequence
  Description of Artificial Sequence: Synthetic oligonucleotide
cggcgactctttaaagagtcgccg

SEQ ID NO: 3110 - DNA, 24 bp, Artificial Sequence
  Description of Artificial Sequence: Synthetic oligonucleotide
cagcgactctttaaagagtcgctg

SEQ ID NO: 3111 - DNA, 24 bp, Artificial Sequence
  Description of Artificial Sequence: Synthetic oligonucleotide
cgacgactctttaaagagtcgtcg

SEQ ID NO: 3112 - DNA, 24 bp, Artificial Sequence
  Description of Artificial Sequence: Synthetic oligonucleotide
cggagactctttaaagagtctccg

SEQ ID NO: 3113 - DNA, 24 bp, Artificial Sequence
  Description of Artificial Sequence: Synthetic oligonucleotide
ctgcgactctttaaagagtcgcag

SEQ ID NO: 3114 - DNA, 24 bp, Artificial Sequence
  Description of Artificial Sequence: Synthetic oligonucleotide
cggtgactctttaaagagtcaccg

SEQ ID NO: 3115 - DNA, 24 bp, Artificial Sequence
  Description of Artificial Sequence: Synthetic oligonucleotide
cacggactctttaaagagtccgtg

SEQ ID NO: 3116 - DNA, 24 bp, Artificial Sequence
  Description of Artificial Sequence: Synthetic oligonucleotide
cccagactctttaaagagtctggg

SEQ ID NO: 3117 - DNA, 24 bp, Artificial Sequence
  Description of Artificial Sequence: Synthetic oligonucleotide
ctcggactctttaaagagtccgag

SEQ ID NO: 3118 - DNA, 24 bp, Artificial Sequence
  Description of Artificial Sequence: Synthetic oligonucleotide
ccctgactctttaaagagtcaggg

SEQ ID NO: 3119 - DNA, 24 bp, Artificial Sequence
  Description of Artificial Sequence: Synthetic oligonucleotide
ccacgactctttaaagagtcgtgg

SEQ ID NO: 3120 - DNA, 24 bp, Artificial Sequence
  Description of Artificial Sequence: Synthetic oligonucleotide
agccgactctttaaagagtcggct

SEQ ID NO: 3121 - DNA, 24 bp, Artificial Sequence
  Description of Artificial Sequence: Synthetic oligonucleotide
tgccgactctttaaagagtcggca

SEQ ID NO: 3122 - DNA, 24 bp, Artificial Sequence
  Description of Artificial Sequence: Synthetic oligonucleotide
gcgagactctttaaagagtctcgc

SEQ ID NO: 3123 - DNA, 24 bp, Artificial Sequence
  Description of Artificial Sequence: Synthetic oligonucleotide
gcgtgactctttaaagagtcacgc

SEQ ID NO: 3124 - DNA, 24 bp, Artificial Sequence
  Description of Artificial Sequence: Synthetic oligonucleotide
gcaggactctttaaagagtcctgc

SEQ ID NO: 3125 - DNA, 24 bp, Artificial Sequence
  Description of Artificial Sequence: Synthetic oligonucleotide
gctggactctttaaagagtccagc

SEQ ID NO: 3126 - DNA, 24 bp, Artificial Sequence
  Description of Artificial Sequence: Synthetic oligonucleotide
cgaggactctttaaagagtcctcg

SEQ ID NO: 3127 - DNA, 24 bp, Artificial Sequence
  Description of Artificial Sequence: Synthetic oligonucleotide
cgtggactctttaaagagtccacg

SEQ ID NO: 3128 - DNA, 24 bp, Artificial Sequence
  Description of Artificial Sequence: Synthetic oligonucleotide
caccgactctttaaagagtcggtg

SEQ ID NO: 3129 - DNA, 24 bp, Artificial Sequence
  Description of Artificial Sequence: Synthetic oligonucleotide
ctccgactctttaaagagtcggag

SEQ ID NO: 3130 - DNA, 24 bp, Artificial Sequence
  Description of Artificial Sequence: Synthetic oligonucleotide
gcgggactctttaaagagtcccgc

SEQ ID NO: 3131 - DNA, 24 bp, Artificial Sequence
  Description of Artificial Sequence: Synthetic oligonucleotide
gagggactctttaaagagtccctc

SEQ ID NO: 3132 - DNA, 24 bp, Artificial Sequence
  Description of Artificial Sequence: Synthetic oligonucleotide
gtgggactctttaaagagtcccac

SEQ ID NO: 3133 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcttgcaagagtcnnnn

SEQ ID NO: 3134 - DNA, 24 bp, Artificial Sequence
  Description of Artificial Sequence: Synthetic oligonucleotide
ggcggactcttgcaagagtccgcc

SEQ ID NO: 3135 - DNA, 24 bp, Artificial Sequence
  Description of Artificial Sequence: Synthetic oligonucleotide
agcggactcttgcaagagtccgct

SEQ ID NO: 3136 - DNA, 24 bp, Artificial Sequence
  Description of Artificial Sequence: Synthetic oligonucleotide
gacggactcttgcaagagtccgtc

SEQ ID NO: 3137 - DNA, 24 bp, Artificial Sequence
  Description of Artificial Sequence: Synthetic oligonucleotide
ggaggactcttgcaagagtcctcc

SEQ ID NO: 3138 - DNA, 24 bp, Artificial Sequence
  Description of Artificial Sequence: Synthetic oligonucleotide
ggcagactcttgcaagagtctgcc

SEQ ID NO: 3139 - DNA, 24 bp, Artificial Sequence
  Description of Artificial Sequence: Synthetic oligonucleotide
tgcggactcttgcaagagtccgca

SEQ ID NO: 3140 - DNA, 24 bp, Artificial Sequence
  Description of Artificial Sequence: Synthetic oligonucleotide
gtcggactcttgcaagagtccgac

SEQ ID NO: 3141 - DNA, 24 bp, Artificial Sequence
  Description of Artificial Sequence: Synthetic oligonucleotide
ggtggactcttgcaagagtccacc

SEQ ID NO: 3142 - DNA, 24 bp, Artificial Sequence
  Description of Artificial Sequence: Synthetic oligonucleotide
ggctgactcttgcaagagtcagcc

SEQ ID NO: 3143 - DNA, 24 bp, Artificial Sequence
  Description of Artificial Sequence: Synthetic oligonucleotide
gcccgactcttgcaagagtcgggc

SEQ ID NO: 3144 - DNA, 24 bp, Artificial Sequence
  Description of Artificial Sequence: Synthetic oligonucleotide
acccgactcttgcaagagtcgggt

SEQ ID NO: 3145 - DNA, 24 bp, Artificial Sequence
  Description of Artificial Sequence: Synthetic oligonucleotide
gaccgactcttgcaagagtcggtc

SEQ ID NO: 3146 - DNA, 24 bp, Artificial Sequence
  Description of Artificial Sequence: Synthetic oligonucleotide
gcacgactcttgcaagagtcgtgc

SEQ ID NO: 3147 - DNA, 24 bp, Artificial Sequence
  Description of Artificial Sequence: Synthetic oligonucleotide
gccagactcttgcaagagtctggc

SEQ ID NO: 3148 - DNA, 24 bp, Artificial Sequence
  Description of Artificial Sequence: Synthetic oligonucleotide
tcccgactcttgcaagagtcggga

SEQ ID NO: 3149 - DNA, 24 bp, Artificial Sequence
  Description of Artificial Sequence: Synthetic oligonucleotide
gtccgactcttgcaagagtcggac

SEQ ID NO: 3150 - DNA, 24 bp, Artificial Sequence
  Description of Artificial Sequence: Synthetic oligonucleotide
gcctgactcttgcaagagtcaggc

SEQ ID NO: 3151 - DNA, 24 bp, Artificial Sequence
  Description of Artificial Sequence: Synthetic oligonucleotide
gggcgactcttgcaagagtcgccc

SEQ ID NO: 3152 - DNA, 24 bp, Artificial Sequence
  Description of Artificial Sequence: Synthetic oligonucleotide
aggcgactcttgcaagagtcgcct

SEQ ID NO: 3153 - DNA, 24 bp, Artificial Sequence
  Description of Artificial Sequence: Synthetic oligonucleotide
gagcgactcttgcaagagtcgctc

SEQ ID NO: 3154 - DNA, 24 bp, Artificial Sequence
  Description of Artificial Sequence: Synthetic oligonucleotide
ggacgactcttgcaagagtcgtcc

SEQ ID NO: 3155 - DNA, 24 bp, Artificial Sequence
  Description of Artificial Sequence: Synthetic oligonucleotide
gggagactcttgcaagagtctccc

SEQ ID NO: 3156 - DNA, 24 bp, Artificial Sequence
  Description of Artificial Sequence: Synthetic oligonucleotide
tggcgactcttgcaagagtcgcca

SEQ ID NO: 3157 - DNA, 24 bp, Artificial Sequence
  Description of Artificial Sequence: Synthetic oligonucleotide
gtgcgactcttgcaagagtcgcac

SEQ ID NO: 3158 - DNA, 24 bp, Artificial Sequence
  Description of Artificial Sequence: Synthetic oligonucleotide
gggtgactcttgcaagagtcaccc

SEQ ID NO: 3159 - DNA, 24 bp, Artificial Sequence
  Description of Artificial Sequence: Synthetic oligonucleotide
acgggactcttgcaagagtcccgt

SEQ ID NO: 3160 - DNA, 24 bp, Artificial Sequence
  Description of Artificial Sequence: Synthetic oligonucleotide
cagggactcttgcaagagtccctg

SEQ ID NO: 3161 - DNA, 24 bp, Artificial Sequence
  Description of Artificial Sequence: Synthetic oligonucleotide
ccaggactcttgcaagagtcctgg

SEQ ID NO: 3162 - DNA, 24 bp, Artificial Sequence
  Description of Artificial Sequence: Synthetic oligonucleotide
ccgagactcttgcaagagtctcgg

SEQ ID NO: 3163 - DNA, 24 bp, Artificial Sequence
  Description of Artificial Sequence: Synthetic oligonucleotide
tcgggactcttgcaagagtcccga

SEQ ID NO: 3164 - DNA, 24 bp, Artificial Sequence
  Description of Artificial Sequence: Synthetic oligonucleotide
ctgggactcttgcaagagtcccag

SEQ ID NO: 3165 - DNA, 24 bp, Artificial Sequence
  Description of Artificial Sequence: Synthetic oligonucleotide
cctggactcttgcaagagtccagg

SEQ ID NO: 3166 - DNA, 24 bp, Artificial Sequence
  Description of Artificial Sequence: Synthetic oligonucleotide
ccgtgactcttgcaagagtcacgg

SEQ ID NO: 3167 - DNA, 24 bp, Artificial Sequence
  Description of Artificial Sequence: Synthetic oligonucleotide
cggcgactcttgcaagagtcgccg

SEQ ID NO: 3168 - DNA, 24 bp, Artificial Sequence
  Description of Artificial Sequence: Synthetic oligonucleotide
cagcgactcttgcaagagtcgctg

SEQ ID NO: 3169 - DNA, 24 bp, Artificial Sequence
  Description of Artificial Sequence: Synthetic oligonucleotide
cgacgactcttgcaagagtcgtcg

SEQ ID NO: 3170 - DNA, 24 bp, Artificial Sequence
  Description of Artificial Sequence: Synthetic oligonucleotide
cggagactcttgcaagagtctccg

SEQ ID NO: 3171 - DNA, 24 bp, Artificial Sequence
  Description of Artificial Sequence: Synthetic oligonucleotide
ctgcgactcttgcaagagtcgcag

SEQ ID NO: 3172 - DNA, 24 bp, Artificial Sequence
  Description of Artificial Sequence: Synthetic oligonucleotide
cggtgactcttgcaagagtcaccg

SEQ ID NO: 3173 - DNA, 24 bp, Artificial Sequence
  Description of Artificial Sequence: Synthetic oligonucleotide
cacggactcttgcaagagtccgtg

SEQ ID NO: 3174 - DNA, 24 bp, Artificial Sequence
  Description of Artificial Sequence: Synthetic oligonucleotide
cccagactcttgcaagagtctggg

SEQ ID NO: 3175 - DNA, 24 bp, Artificial Sequence
  Description of Artificial Sequence: Synthetic oligonucleotide
ctcggactcttgcaagagtccgag

SEQ ID NO: 3176 - DNA, 24 bp, Artificial Sequence
  Description of Artificial Sequence: Synthetic oligonucleotide
ccctgactcttgcaagagtcaggg

SEQ ID NO: 3177 - DNA, 24 bp, Artificial Sequence
  Description of Artificial Sequence: Synthetic oligonucleotide
ccacgactcttgcaagagtcgtgg

SEQ ID NO: 3178 - DNA, 24 bp, Artificial Sequence
  Description of Artificial Sequence: Synthetic oligonucleotide
agccgactcttgcaagagtcggct

SEQ ID NO: 3179 - DNA, 24 bp, Artificial Sequence
  Description of Artificial Sequence: Synthetic oligonucleotide
tgccgactcttgcaagagtcggca

SEQ ID NO: 3180 - DNA, 24 bp, Artificial Sequence
  Description of Artificial Sequence: Synthetic oligonucleotide
gcgagactcttgcaagagtctcgc

SEQ ID NO: 3181 - DNA, 24 bp, Artificial Sequence
  Description of Artificial Sequence: Synthetic oligonucleotide
gcgtgactcttgcaagagtcacgc

SEQ ID NO: 3182 - DNA, 24 bp, Artificial Sequence
  Description of Artificial Sequence: Synthetic oligonucleotide
gcaggactcttgcaagagtcctgc

SEQ ID NO: 3183 - DNA, 24 bp, Artificial Sequence
  Description of Artificial Sequence: Synthetic oligonucleotide
gctggactcttgcaagagtccagc

SEQ ID NO: 3184 - DNA, 24 bp, Artificial Sequence
  Description of Artificial Sequence: Synthetic oligonucleotide
cgaggactcttgcaagagtcctcg

SEQ ID NO: 3185 - DNA, 24 bp, Artificial Sequence
  Description of Artificial Sequence: Synthetic oligonucleotide
cgtggactcttgcaagagtccacg

SEQ ID NO: 3186 - DNA, 24 bp, Artificial Sequence
  Description of Artificial Sequence: Synthetic oligonucleotide
caccgactcttgcaagagtcggtg

SEQ ID NO: 3187 - DNA, 24 bp, Artificial Sequence
  Description of Artificial Sequence: Synthetic oligonucleotide
ctccgactcttgcaagagtcggag

SEQ ID NO: 3188 - DNA, 24 bp, Artificial Sequence
  Description of Artificial Sequence: Synthetic oligonucleotide
gcgggactcttgcaagagtcccgc

SEQ ID NO: 3189 - DNA, 24 bp, Artificial Sequence
  Description of Artificial Sequence: Synthetic oligonucleotide
gagggactcttgcaagagtccctc

SEQ ID NO: 3190 - DNA, 24 bp, Artificial Sequence
  Description of Artificial Sequence: Synthetic oligonucleotide
gtgggactcttgcaagagtcccac

SEQ ID NO: 3191 - DNA, 24 bp, Artificial Sequence
  Description of Artificial Sequence: Synthetic oligonucleotide
  modified_base (1)..(4): a, c, t, or g
  modified_base (21)..(24): a, c, t, or g
nnnngactcttcgaagagtcnnnn

SEQ ID NO: 3192 - DNA, 24 bp, Artificial Sequence
  Description of Artificial Sequence: Synthetic oligonucleotide
ggcggactcttcgaagagtccgcc

SEQ ID NO: 3193 - DNA, 24 bp, Artificial Sequence
  Description of Artificial Sequence: Synthetic oligonucleotide
agcggactcttcgaagagtccgct

SEQ ID NO: 3194 - DNA, 24 bp, Artificial Sequence
  Description of Artificial Sequence: Synthetic oligonucleotide
gacggactcttcgaagagtccgtc

SEQ ID NO: 3195 - DNA, 24 bp, Artificial Sequence
  Description of Artificial Sequence: Synthetic oligonucleotide
ggaggactcttcgaagagtcctcc

SEQ ID NO: 3196 - DNA, 24 bp, Artificial Sequence
  Description of Artificial Sequence: Synthetic oligonucleotide
ggcagactcttcgaagagtctgcc

SEQ ID NO: 3197 - DNA, 24 bp, Artificial Sequence
  Description of Artificial Sequence: Synthetic oligonucleotide
tgcggactcttcgaagagtccgca

SEQ ID NO: 3198 - DNA, 24 bp, Artificial Sequence
  Description of Artificial Sequence: Synthetic oligonucleotide
gtcggactcttcgaagagtccgac

SEQ ID NO: 3199 - DNA, 24 bp, Artificial Sequence
  Description of Artificial Sequence: Synthetic oligonucleotide
ggtggactcttcgaagagtccacc

SEQ ID NO: 3200 - DNA, 24 bp, Artificial Sequence
  Description of Artificial Sequence: Synthetic oligonucleotide
ggctgactcttcgaagagtcagcc

SEQ ID NO: 3201 - DNA, 24 bp, Artificial Sequence
  Description of Artificial Sequence: Synthetic oligonucleotide
gcccgactcttcgaagagtcgggc

SEQ ID NO: 3202 - DNA, 24 bp, Artificial Sequence
  Description of Artificial Sequence: Synthetic oligonucleotide
acccgactcttcgaagagtcgggt

SEQ ID NO: 3203 - DNA, 24 bp, Artificial Sequence
  Description of Artificial Sequence: Synthetic oligonucleotide
gaccgactcttcgaagagtcggtc

SEQ ID NO: 3204 - DNA, 24 bp, Artificial Sequence
  Description of Artificial Sequence: Synthetic oligonucleotide
gcacgactcttcgaagagtcgtgc

SEQ ID NO: 3205 - DNA, 24 bp, Artificial Sequence
  Description of Artificial Sequence: Synthetic oligonucleotide
gccagactcttcgaagagtctggc

SEQ ID NO: 3206 - DNA, 24 bp, Artificial Sequence
  Description of Artificial Sequence: Synthetic oligonucleotide
tcccgactcttcgaagagtcggga

SEQ ID NO: 3207 - DNA, 24 bp, Artificial Sequence
  Description of Artificial Sequence: Synthetic oligonucleotide
gtccgactcttcgaagagtcggac

SEQ ID NO: 3208 - DNA, 24 bp, Artificial Sequence
  Description of Artificial Sequence: Synthetic oligonucleotide
gcctgactcttcgaagagtcaggc

SEQ ID NO: 3209 - DNA, 24 bp, Artificial Sequence
  Description of Artificial Sequence: Synthetic oligonucleotide
gggcgactcttcgaagagtcgccc

SEQ ID NO: 3210 - DNA, 24 bp, Artificial Sequence
  Description of Artificial Sequence: Synthetic oligonucleotide
aggcgactcttcgaagagtcgcct

SEQ ID NO: 3211 - DNA, 24 bp, Artificial Sequence
  Description of Artificial Sequence: Synthetic oligonucleotide
gagcgactcttcgaagagtcgctc

SEQ ID NO: 3212 - DNA, 24 bp, Artificial Sequence
  Description of Artificial Sequence: Synthetic oligonucleotide
ggacgactcttcgaagagtcgtcc

SEQ ID NO: 3213 - DNA, 24 bp, Artificial Sequence
  Description of Artificial Sequence: Synthetic oligonucleotide
gggagactcttcgaagagtctccc

SEQ ID NO: 3214 - DNA, 24 bp, Artificial Sequence
  Description of Artificial Sequence: Synthetic oligonucleotide
tggcgactcttcgaagagtcgcca

SEQ ID NO: 3215 - DNA, 24 bp, Artificial Sequence
  Description of Artificial Sequence: Synthetic oligonucleotide
gtgcgactcttcgaagagtcgcac

SEQ ID NO: 3216 - DNA, 24 bp, Artificial Sequence
  Description of Artificial Sequence: Synthetic oligonucleotide
gggtgactcttcgaagagtcaccc

SEQ ID NO: 3217 - DNA, 24 bp, Artificial Sequence
  Description of Artificial Sequence: Synthetic oligonucleotide
acgggactcttcgaagagtcccgt

SEQ ID NO: 3218 - DNA, 24 bp, Artificial Sequence
  Description of Artificial Sequence: Synthetic oligonucleotide
cagggactcttcgaagagtccctg

SEQ ID NO: 3219 - DNA, 24 bp, Artificial Sequence
  Description of Artificial Sequence: Synthetic oligonucleotide
ccaggactcttcgaagagtcctgg

SEQ ID NO: 3220 - DNA, 24 bp, Artificial Sequence
  Description of Artificial Sequence: Synthetic oligonucleotide
ccgagactcttcgaagagtctcgg

SEQ ID NO: 3221 - DNA, 24 bp, Artificial Sequence
  Description of Artificial Sequence: Synthetic oligonucleotide
tcgggactcttcgaagagtcccga

SEQ ID NO: 3222 - DNA, 24 bp, Artificial Sequence
  Description of Artificial Sequence: Synthetic oligonucleotide
ctgggactcttcgaagagtcccag

SEQ ID NO: 3223 - DNA, 24 bp, Artificial Sequence
  Description of Artificial Sequence: Synthetic oligonucleotide
cctggactcttcgaagagtccagg

SEQ ID NO: 3224 - DNA, 24 bp, Artificial Sequence
  Description of Artificial Sequence: Synthetic oligonucleotide
ccgtgactcttcgaagagtcacgg

SEQ ID NO: 3225 - DNA, 24 bp, Artificial Sequence
  Description of Artificial Sequence: Synthetic oligonucleotide
cggcgactcttcgaagagtcgccg

SEQ ID NO: 3226 - DNA, 24 bp, Artificial Sequence
  Description of Artificial Sequence: Synthetic oligonucleotide
cagcgactcttcgaagagtcgctg

SEQ ID NO: 3227 - DNA, 24 bp, Artificial Sequence
  Description of Artificial Sequence: Synthetic oligonucleotide
cgacgactcttcgaagagtcgtcg

SEQ ID NO: 3228 - DNA, 24 bp, Artificial Sequence
  Description of Artificial Sequence: Synthetic oligonucleotide
cggagactcttcgaagagtctccg

SEQ ID NO: 3229 - DNA, 24 bp, Artificial Sequence
  Description of Artificial Sequence: Synthetic oligonucleotide
ctgcgactcttcgaagagtcgcag

SEQ ID NO: 3230 - DNA, 24 bp, Artificial Sequence
  Description of Artificial Sequence: Synthetic oligonucleotide
cggtgactcttcgaagagtcaccg

SEQ ID NO: 3231 - DNA, 24 bp, Artificial Sequence
  Description of Artificial Sequence: Synthetic oligonucleotide
cacggactcttcgaagagtccgtg

SEQ ID NO: 3232 - DNA, 24 bp, Artificial Sequence
  Description of Artificial Sequence: Synthetic oligonucleotide
cccagactcttcgaagagtctggg

SEQ ID NO: 3233 - DNA, 24 bp, Artificial Sequence
  Description of Artificial Sequence: Synthetic oligonucleotide
ctcggactcttcgaagagtccgag

SEQ ID NO: 3234 - DNA, 24 bp, Artificial Sequence
  Description of Artificial Sequence: Synthetic oligonucleotide
ccctgactcttcgaagagtcaggg

SEQ ID NO: 3235 - DNA, 24 bp, Artificial Sequence
  Description of Artificial Sequence: Synthetic oligonucleotide
ccacgactcttcgaagagtcgtgg

SEQ ID NO: 3236 - DNA, 24 bp, Artificial Sequence
  Description of Artificial Sequence: Synthetic oligonucleotide
agccgactcttcgaagagtcggct

SEQ ID NO: 3237 - DNA, 24 bp, Artificial Sequence
  Description of Artificial Sequence: Synthetic oligonucleotide
tgccgactcttcgaagagtcggca

SEQ ID NO: 3238 - DNA, 24 bp, Artificial Sequence
  Description of Artificial Sequence: Synthetic oligonucleotide
gcgagactcttcgaagagtctcgc

SEQ ID NO: 3239 - DNA, 24 bp, Artificial Sequence
  Description of Artificial Sequence: Synthetic oligonucleotide
gcgtgactcttcgaagagtcacgc

SEQ ID NO: 3240 - DNA, 24 bp, Artificial Sequence
  Description of Artificial Sequence: Synthetic oligonucleotide
gcaggactcttcgaagagtcctgc

SEQ ID NO: 3241 - DNA, 24 bp, Artificial Sequence
  Description of Artificial Sequence: Synthetic oligonucleotide
gctggactcttcgaagagtccagc

SEQ ID NO: 3242 - DNA, 24 bp, Artificial Sequence
  Description of Artificial Sequence: Synthetic oligonucleotide
cgaggactcttcgaagagtcctcg

SEQ ID NO: 3243 - DNA, 24 bp, Artificial Sequence
  Description of Artificial Sequence: Synthetic oligonucleotide
cgtggactcttcgaagagtccacg

SEQ ID NO: 3244 - DNA, 24 bp, Artificial Sequence
  Description of Artificial Sequence: Synthetic oligonucleotide
caccgactcttcgaagagtcggtg

SEQ ID NO: 3245 - DNA, 24 bp, Artificial Sequence
  Description of Artificial Sequence: Synthetic oligonucleotide
ctccgactcttcgaagagtcggag

SEQ ID NO: 3246 - DNA, 24 bp, Artificial Sequence
  Description of Artificial Sequence: Synthetic oligonucleotide
gcgggactcttcgaagagtcccgc

SEQ ID NO: 3247 - DNA, 24 bp, Artificial Sequence
  Description of Artificial Sequence: Synthetic oligonucleotide
gagggactcttcgaagagtccctc

SEQ ID NO: 3248 - DNA, 24 bp, Artificial Sequence
  Description of Artificial Sequence: Synthetic oligonucleotide
gtgggactcttcgaagagtcccac

SEQ ID NO: 3249 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccgatcggagtcnnnn

SEQ ID NO: 3250 - DNA, 23 bp, Artificial Sequence
  Description of Artificial Sequence: Synthetic oligonucleotide
gcggactccgatcggagtccgcc

SEQ ID NO: 3251 - DNA, 23 bp, Artificial Sequence
  Description of Artificial Sequence: Synthetic oligonucleotide
gcggactccgatcggagtccgct

SEQ ID NO: 3252 - DNA, 23 bp, Artificial Sequence
  Description of Artificial Sequence: Synthetic oligonucleotide
acggactccgatcggagtccgtc

SEQ ID NO: 3253 - DNA, 23 bp, Artificial Sequence
  Description of Artificial Sequence: Synthetic oligonucleotide
gaggactccgatcggagtcctcc

SEQ ID NO: 3254 - DNA, 23 bp, Artificial Sequence
  Description of Artificial Sequence: Synthetic oligonucleotide
gcagactccgatcggagtctgcc

SEQ ID NO: 3255 - DNA, 23 bp, Artificial Sequence
  Description of Artificial Sequence: Synthetic oligonucleotide
gcggactccgatcggagtccgca

SEQ ID NO: 3256 - DNA, 23 bp, Artificial Sequence
  Description of Artificial Sequence: Synthetic oligonucleotide
tcggactccgatcggagtccgac

SEQ ID NO: 3257 - DNA, 23 bp, Artificial Sequence
  Description of Artificial Sequence: Synthetic oligonucleotide
gtggactccgatcggagtccacc

SEQ ID NO: 3258 - DNA, 23 bp, Artificial Sequence
  Description of Artificial Sequence: Synthetic oligonucleotide
gctgactccgatcggagtcagcc

SEQ ID NO: 3259 - DNA, 23 bp, Artificial Sequence
  Description of Artificial Sequence: Synthetic oligonucleotide
cccgactccgatcggagtcgggc

SEQ ID NO: 3260 - DNA, 23 bp, Artificial Sequence
  Description of Artificial Sequence: Synthetic oligonucleotide
cccgactccgatcggagtcgggt

SEQ ID NO: 3261 - DNA, 23 bp, Artificial Sequence
  Description of Artificial Sequence: Synthetic oligonucleotide
accgactccgatcggagtcggtc

SEQ ID NO: 3262 - DNA, 23 bp, Artificial Sequence
  Description of Artificial Sequence: Synthetic oligonucleotide
cacgactccgatcggagtcgtgc

SEQ ID NO: 3263 - DNA, 23 bp, Artificial Sequence
  Description of Artificial Sequence: Synthetic oligonucleotide
ccagactccgatcggagtctggc

SEQ ID NO: 3264 - DNA, 23 bp, Artificial Sequence
  Description of Artificial Sequence: Synthetic oligonucleotide
cccgactccgatcggagtcggga

SEQ ID NO: 3265 - DNA, 23 bp, Artificial Sequence
  Description of Artificial Sequence: Synthetic oligonucleotide
tccgactccgatcggagtcggac

SEQ ID NO: 3266 - DNA, 23 bp, Artificial Sequence
  Description of Artificial Sequence: Synthetic oligonucleotide
cctgactccgatcggagtcaggc

SEQ ID NO: 3267 - DNA, 23 bp, Artificial Sequence
  Description of Artificial Sequence: Synthetic oligonucleotide
ggcgactccgatcggagtcgccc

SEQ ID NO: 3268 - DNA, 23 bp, Artificial Sequence
  Description of Artificial Sequence: Synthetic oligonucleotide
ggcgactccgatcggagtcgcct

SEQ ID NO: 3269 - DNA, 23 bp, Artificial Sequence
  Description of Artificial Sequence: Synthetic oligonucleotide
agcgactccgatcggagtcgctc

SEQ ID NO: 3270 - DNA, 23 bp, Artificial Sequence
  Description of Artificial Sequence: Synthetic oligonucleotide
gacgactccgatcggagtcgtcc

SEQ ID NO: 3271 - DNA, 23 bp, Artificial Sequence
  Description of Artificial Sequence: Synthetic oligonucleotide
ggagactccgatcggagtctccc

SEQ ID NO: 3272 - DNA, 23 bp, Artificial Sequence
  Description of Artificial Sequence: Synthetic oligonucleotide
ggcgactccgatcggagtcgcca

SEQ ID NO: 3273 - DNA, 23 bp, Artificial Sequence
  Description of Artificial Sequence: Synthetic oligonucleotide
tgcgactccgatcggagtcgcac

SEQ ID NO: 3274 - DNA, 23 bp, Artificial Sequence
  Description of Artificial Sequence: Synthetic oligonucleotide
ggtgactccgatcggagtcaccc

SEQ ID NO: 3275 - DNA, 23 bp, Artificial Sequence
  Description of Artificial Sequence: Synthetic oligonucleotide
cgggactccgatcggagtcccgt

SEQ ID NO: 3276 - DNA, 23 bp, Artificial Sequence
  Description of Artificial Sequence: Synthetic oligonucleotide
agggactccgatcggagtccctg

SEQ ID NO: 3277 - DNA, 23 bp, Artificial Sequence
  Description of Artificial Sequence: Synthetic oligonucleotide
caggactccgatcggagtcctgg

SEQ ID NO: 3278 - DNA, 23 bp, Artificial Sequence
  Description of Artificial Sequence: Synthetic oligonucleotide
cgagactccgatcggagtctcgg

SEQ ID NO: 3279 - DNA, 23 bp, Artificial Sequence
  Description of Artificial Sequence: Synthetic oligonucleotide
cgggactccgatcggagtcccga

SEQ ID NO: 3280 - DNA, 23 bp, Artificial Sequence
  Description of Artificial Sequence: Synthetic oligonucleotide
tgggactccgatcggagtcccag

SEQ ID NO: 3281 - DNA, 23 bp, Artificial Sequence
  Description of Artificial Sequence: Synthetic oligonucleotide
ctggactccgatcggagtccagg

SEQ ID NO: 3282 - DNA, 23 bp, Artificial Sequence
  Description of Artificial Sequence: Synthetic oligonucleotide
cgtgactccgatcggagtcacgg

SEQ ID NO: 3283 - DNA, 23 bp, Artificial Sequence
  Description of Artificial Sequence: Synthetic oligonucleotide
ggcgactccgatcggagtcgccg

SEQ ID NO: 3284 - DNA, 23 bp, Artificial Sequence
  Description of Artificial Sequence: Synthetic oligonucleotide
agcgactccgatcggagtcgctg

SEQ ID NO: 3285 - DNA, 23 bp, Artificial Sequence
  Description of Artificial Sequence: Synthetic oligonucleotide
gacgactccgatcggagtcgtcg

SEQ ID NO: 3286 - DNA, 23 bp, Artificial Sequence
  Description of Artificial Sequence: Synthetic oligonucleotide
ggagactccgatcggagtctccg

SEQ ID NO: 3287 - DNA, 23 bp, Artificial Sequence
  Description of Artificial Sequence: Synthetic oligonucleotide
tgcgactccgatcggagtcgcag

SEQ ID NO: 3288 - DNA, 23 bp, Artificial Sequence
  Description of Artificial Sequence: Synthetic oligonucleotide
ggtgactccgatcggagtcaccg

SEQ ID NO: 3289 - DNA, 23 bp, Artificial Sequence
  Description of Artificial Sequence: Synthetic oligonucleotide
acggactccgatcggagtccgtg

SEQ ID NO: 3290 - DNA, 23 bp, Artificial Sequence
  Description of Artificial Sequence: Synthetic oligonucleotide
ccagactccgatcggagtctggg

SEQ ID NO: 3291 - DNA, 23 bp, Artificial Sequence
  Description of Artificial Sequence: Synthetic oligonucleotide
tcggactccgatcggagtccgag

SEQ ID NO: 3292 - DNA, 23 bp, Artificial Sequence
  Description of Artificial Sequence: Synthetic oligonucleotide
cctgactccgatcggagtcaggg

SEQ ID NO: 3293 - DNA, 23 bp, Artificial Sequence
  Description of Artificial Sequence: Synthetic oligonucleotide
cacgactccgatcggagtcgtgg

SEQ ID NO: 3294 - DNA, 23 bp, Artificial Sequence
  Description of Artificial Sequence: Synthetic oligonucleotide
gccgactccgatcggagtcggct

SEQ ID NO: 3295 - DNA, 23 bp, Artificial Sequence
  Description of Artificial Sequence: Synthetic oligonucleotide
gccgactccgatcggagtcggca

SEQ ID NO: 3296 - DNA, 23 bp, Artificial Sequence
  Description of Artificial Sequence: Synthetic oligonucleotide
cgagactccgatcggagtctcgc

SEQ ID NO: 3297 - DNA, 23 bp, Artificial Sequence
  Description of Artificial Sequence: Synthetic oligonucleotide
cgtgactccgatcggagtcacgc

SEQ ID NO: 3298 - DNA, 23 bp, Artificial Sequence
  Description of Artificial Sequence: Synthetic oligonucleotide
caggactccgatcggagtcctgc

SEQ ID NO: 3299 - DNA, 23 bp, Artificial Sequence
  Description of Artificial Sequence: Synthetic oligonucleotide
ctggactccgatcggagtccagc

SEQ ID NO: 3300 - DNA, 23 bp, Artificial Sequence
  Description of Artificial Sequence: Synthetic oligonucleotide
gaggactccgatcggagtcctcg

SEQ ID NO: 3301 - DNA, 23 bp, Artificial Sequence
  Description of Artificial Sequence: Synthetic oligonucleotide
gtggactccgatcggagtccacg

SEQ ID NO: 3302 - DNA, 23 bp, Artificial Sequence
  Description of Artificial Sequence: Synthetic oligonucleotide
accgactccgatcggagtcggtg

SEQ ID NO: 3303 - DNA, 23 bp, Artificial Sequence
  Description of Artificial Sequence: Synthetic oligonucleotide
tccgactccgatcggagtcggag

SEQ ID NO: 3304 - DNA, 23 bp, Artificial Sequence
  Description of Artificial Sequence: Synthetic oligonucleotide
cgggactccgatcggagtcccgc

SEQ ID NO: 3305 - DNA, 23 bp, Artificial Sequence
  Description of Artificial Sequence: Synthetic oligonucleotide
agggactccgatcggagtccctc

SEQ ID NO: 3306 - DNA, 23 bp, Artificial Sequence
  Description of Artificial Sequence: Synthetic oligonucleotide
tgggactccgatcggagtcccac

SEQ ID NO: 3307 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccgtacggagtcnnnn

SEQ ID NO: 3308 - DNA, 23 bp, Artificial Sequence
  Description of Artificial Sequence: Synthetic oligonucleotide
gcggactccgtacggagtccgcc

SEQ ID NO: 3309 - DNA, 23 bp, Artificial Sequence
  Description of Artificial Sequence: Synthetic oligonucleotide
gcggactccgtacggagtccgct

SEQ ID NO: 3310 - DNA, 23 bp, Artificial Sequence
  Description of Artificial Sequence: Synthetic oligonucleotide
acggactccgtacggagtccgtc

SEQ ID NO: 3311 - DNA, 23 bp, Artificial Sequence
  Description of Artificial Sequence: Synthetic oligonucleotide
gaggactccgtacggagtcctcc

SEQ ID NO: 3312 - DNA, 23 bp, Artificial Sequence
  Description of Artificial Sequence: Synthetic oligonucleotide
gcagactccgtacggagtctgcc

SEQ ID NO: 3313 - DNA, 23 bp, Artificial Sequence
  Description of Artificial Sequence: Synthetic oligonucleotide
gcggactccgtacggagtccgca

SEQ ID NO: 3314 - DNA, 23 bp, Artificial Sequence
  Description of Artificial Sequence: Synthetic oligonucleotide
tcggactccgtacggagtccgac

SEQ ID NO: 3315 - DNA, 23 bp, Artificial Sequence
  Description of Artificial Sequence: Synthetic oligonucleotide
gtggactccgtacggagtccacc

SEQ ID NO: 3316 - DNA, 23 bp, Artificial Sequence
  Description of Artificial Sequence: Synthetic oligonucleotide
gctgactccgtacggagtcagcc

SEQ ID NO: 3317 - DNA, 23 bp, Artificial Sequence
  Description of Artificial Sequence: Synthetic oligonucleotide
cccgactccgtacggagtcgggc

SEQ ID NO: 3318 - DNA, 23 bp, Artificial Sequence
  Description of Artificial Sequence: Synthetic oligonucleotide
cccgactccgtacggagtcgggt

SEQ ID NO: 3319 - DNA, 23 bp, Artificial Sequence
  Description of Artificial Sequence: Synthetic oligonucleotide
accgactccgtacggagtcggtc

SEQ ID NO: 3320 - DNA, 23 bp, Artificial Sequence
  Description of Artificial Sequence: Synthetic oligonucleotide
cacgactccgtacggagtcgtgc

SEQ ID NO: 3321 - DNA, 23 bp, Artificial Sequence
  Description of Artificial Sequence: Synthetic oligonucleotide
ccagactccgtacggagtctggc

SEQ ID NO: 3322 - DNA, 23 bp, Artificial Sequence
  Description of Artificial Sequence: Synthetic oligonucleotide
cccgactccgtacggagtcggga

SEQ ID NO: 3323 - DNA, 23 bp, Artificial Sequence
  Description of Artificial Sequence: Synthetic oligonucleotide
tccgactccgtacggagtcggac

SEQ ID NO: 3324 - DNA, 23 bp, Artificial Sequence
  Description of Artificial Sequence: Synthetic oligonucleotide
cctgactccgtacggagtcaggc

SEQ ID NO: 3325 - DNA, 23 bp, Artificial Sequence
  Description of Artificial Sequence: Synthetic oligonucleotide
ggcgactccgtacggagtcgccc

SEQ ID NO: 3326 - DNA, 23 bp, Artificial Sequence
  Description of Artificial Sequence: Synthetic oligonucleotide
ggcgactccgtacggagtcgcct

SEQ ID NO: 3327 - DNA, 23 bp, Artificial Sequence
  Description of Artificial Sequence: Synthetic oligonucleotide
agcgactccgtacggagtcgctc

SEQ ID NO: 3328 - DNA, 23 bp, Artificial Sequence
  Description of Artificial Sequence: Synthetic oligonucleotide
gacgactccgtacggagtcgtcc

SEQ ID NO: 3329 - DNA, 23 bp, Artificial Sequence
  Description of Artificial Sequence: Synthetic oligonucleotide
ggagactccgtacggagtctccc

SEQ ID NO: 3330 - DNA, 23 bp, Artificial Sequence
  Description of Artificial Sequence: Synthetic oligonucleotide
ggcgactccgtacggagtcgcca

SEQ ID NO: 3331 - DNA, 23 bp, Artificial Sequence
  Description of Artificial Sequence: Synthetic oligonucleotide
tgcgactccgtacggagtcgcac

SEQ ID NO: 3332 - DNA, 23 bp, Artificial Sequence
  Description of Artificial Sequence: Synthetic oligonucleotide
ggtgactccgtacggagtcaccc

SEQ ID NO: 3333 - DNA, 23 bp, Artificial Sequence
  Description of Artificial Sequence: Synthetic oligonucleotide
cgggactccgtacggagtcccgt

SEQ ID NO: 3334 - DNA, 23 bp, Artificial Sequence
  Description of Artificial Sequence: Synthetic oligonucleotide
agggactccgtacggagtccctg

SEQ ID NO: 3335 - DNA, 23 bp, Artificial Sequence
  Description of Artificial Sequence: Synthetic oligonucleotide
caggactccgtacggagtcctgg

SEQ ID NO: 3336 - DNA, 23 bp, Artificial Sequence
  Description of Artificial Sequence: Synthetic oligonucleotide
cgagactccgtacggagtctcgg

SEQ ID NO: 3337 - DNA, 23 bp, Artificial Sequence
  Description of Artificial Sequence: Synthetic oligonucleotide
cgggactccgtacggagtcccga

SEQ ID NO: 3338 - DNA, 23 bp, Artificial Sequence
  Description of Artificial Sequence: Synthetic oligonucleotide
tgggactccgtacggagtcccag

SEQ ID NO: 3339 - DNA, 23 bp, Artificial Sequence
  Description of Artificial Sequence: Synthetic oligonucleotide
ctggactccgtacggagtccagg

SEQ ID NO: 3340 - DNA, 23 bp, Artificial Sequence
  Description of Artificial Sequence: Synthetic oligonucleotide
cgtgactccgtacggagtcacgg

SEQ ID NO: 3341 - DNA, 23 bp, Artificial Sequence
  Description of Artificial Sequence: Synthetic oligonucleotide
ggcgactccgtacggagtcgccg

SEQ ID NO: 3342 - DNA, 23 bp, Artificial Sequence
  Description of Artificial Sequence: Synthetic oligonucleotide
agcgactccgtacggagtcgctg

SEQ ID NO: 3343 - DNA, 23 bp, Artificial Sequence
  Description of Artificial Sequence: Synthetic oligonucleotide
gacgactccgtacggagtcgtcg

SEQ ID NO: 3344 - DNA, 23 bp, Artificial Sequence
  Description of Artificial Sequence: Synthetic oligonucleotide
ggagactccgtacggagtctccg

SEQ ID NO: 3345 - DNA, 23 bp, Artificial Sequence
  Description of Artificial Sequence: Synthetic oligonucleotide
tgcgactccgtacggagtcgcag

SEQ ID NO: 3346 - DNA, 23 bp, Artificial Sequence
  Description of Artificial Sequence: Synthetic oligonucleotide
ggtgactccgtacggagtcaccg

SEQ ID NO: 3347 - DNA, 23 bp, Artificial Sequence
  Description of Artificial Sequence: Synthetic oligonucleotide
acggactccgtacggagtccgtg

SEQ ID NO: 3348 - DNA, 23 bp, Artificial Sequence
  Description of Artificial Sequence: Synthetic oligonucleotide
ccagactccgtacggagtctggg

SEQ ID NO: 3349 - DNA, 23 bp, Artificial Sequence
  Description of Artificial Sequence: Synthetic oligonucleotide
tcggactccgtacggagtccgag

SEQ ID NO: 3350 - DNA, 23 bp, Artificial Sequence
  Description of Artificial Sequence: Synthetic oligonucleotide
cctgactccgtacggagtcaggg

SEQ ID NO: 3351 - DNA, 23 bp, Artificial Sequence
  Description of Artificial Sequence: Synthetic oligonucleotide
cacgactccgtacggagtcgtgg

SEQ ID NO: 3352 - DNA, 23 bp, Artificial Sequence
  Description of Artificial Sequence: Synthetic oligonucleotide
gccgactccgtacggagtcggct

SEQ ID NO: 3353 - DNA, 23 bp, Artificial Sequence
  Description of Artificial Sequence: Synthetic oligonucleotide
gccgactccgtacggagtcggca

SEQ ID NO: 3354 - DNA, 23 bp, Artificial Sequence
  Description of Artificial Sequence: Synthetic oligonucleotide
cgagactccgtacggagtctcgc

SEQ ID NO: 3355 - DNA, 23 bp, Artificial Sequence
  Description of Artificial Sequence: Synthetic oligonucleotide
cgtgactccgtacggagtcacgc

SEQ ID NO: 3356 - DNA, 23 bp, Artificial Sequence
  Description of Artificial Sequence: Synthetic oligonucleotide
caggactccgtacggagtcctgc

SEQ ID NO: 3357 - DNA, 23 bp, Artificial Sequence
  Description of Artificial Sequence: Synthetic oligonucleotide
ctggactccgtacggagtccagc

SEQ ID NO: 3358 - DNA, 23 bp, Artificial Sequence
  Description of Artificial Sequence: Synthetic oligonucleotide
gaggactccgtacggagtcctcg

SEQ ID NO: 3359 - DNA, 23 bp, Artificial Sequence
  Description of Artificial Sequence: Synthetic oligonucleotide
gtggactccgtacggagtccacg

SEQ ID NO: 3360 - DNA, 23 bp, Artificial Sequence
  Description of Artificial Sequence: Synthetic oligonucleotide
accgactccgtacggagtcggtg

SEQ ID NO: 3361 - DNA, 23 bp, Artificial Sequence
  Description of Artificial Sequence: Synthetic oligonucleotide
tccgactccgtacggagtcggag

SEQ ID NO: 3362 - DNA, 23 bp, Artificial Sequence
  Description of Artificial Sequence: Synthetic oligonucleotide
cgggactccgtacggagtcccgc

SEQ ID NO: 3363 - DNA, 23 bp, Artificial Sequence
  Description of Artificial Sequence: Synthetic oligonucleotide
agggactccgtacggagtccctc

SEQ ID NO: 3364 - DNA, 23 bp, Artificial Sequence
  Description of Artificial Sequence: Synthetic oligonucleotide
tgggactccgtacggagtcccac

SEQ ID NO: 3365 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccggccggagtcnnnn

SEQ ID NO: 3366 - DNA, 23 bp, Artificial Sequence
  Description of Artificial Sequence: Synthetic oligonucleotide
gcggactccggccggagtccgcc

SEQ ID NO: 3367 - DNA, 23 bp, Artificial Sequence
  Description of Artificial Sequence: Synthetic oligonucleotide
gcggactccggccggagtccgct

SEQ ID NO: 3368 - DNA, 23 bp, Artificial Sequence
  Description of Artificial Sequence: Synthetic oligonucleotide
acggactccggccggagtccgtc

SEQ ID NO: 3369 - DNA, 23 bp, Artificial Sequence
  Description of Artificial Sequence: Synthetic oligonucleotide
gaggactccggccggagtcctcc

SEQ ID NO: 3370 - DNA, 23 bp, Artificial Sequence
  Description of Artificial Sequence: Synthetic oligonucleotide
gcagactccggccggagtctgcc

SEQ ID NO: 3371 - DNA, 23 bp, Artificial Sequence
  Description of Artificial Sequence: Synthetic oligonucleotide
gcggactccggccggagtccgca

SEQ ID NO: 3372 - DNA, 23 bp, Artificial Sequence
  Description of Artificial Sequence: Synthetic oligonucleotide
tcggactccggccggagtccgac

SEQ ID NO: 3373 - DNA, 23 bp, Artificial Sequence
  Description of Artificial Sequence: Synthetic oligonucleotide
gtggactccggccggagtccacc

SEQ ID NO: 3374 - DNA, 23 bp, Artificial Sequence
  Description of Artificial Sequence: Synthetic oligonucleotide
gctgactccggccggagtcagcc

SEQ ID NO: 3375 - DNA, 23 bp, Artificial Sequence
  Description of Artificial Sequence: Synthetic oligonucleotide
cccgactccggccggagtcgggc

SEQ ID NO: 3376 - DNA, 23 bp, Artificial Sequence
  Description of Artificial Sequence: Synthetic oligonucleotide
cccgactccggccggagtcgggt

SEQ ID NO: 3377 - DNA, 23 bp, Artificial Sequence
  Description of Artificial Sequence: Synthetic oligonucleotide
accgactccggccggagtcggtc

SEQ ID NO: 3378 - DNA, 23 bp, Artificial Sequence
  Description of Artificial Sequence: Synthetic oligonucleotide
cacgactccggccggagtcgtgc

SEQ ID NO: 3379 - DNA, 23 bp, Artificial Sequence
  Description of Artificial Sequence: Synthetic oligonucleotide
ccagactccggccggagtctggc

SEQ ID NO: 3380 - DNA, 23 bp, Artificial Sequence
  Description of Artificial Sequence: Synthetic oligonucleotide
cccgactccggccggagtcggga

SEQ ID NO: 3381 - DNA, 23 bp, Artificial Sequence
  Description of Artificial Sequence: Synthetic oligonucleotide
tccgactccggccggagtcggac

SEQ ID NO: 3382 - DNA, 23 bp, Artificial Sequence
  Description of Artificial Sequence: Synthetic oligonucleotide
cctgactccggccggagtcaggc

SEQ ID NO: 3383 - DNA, 23 bp, Artificial Sequence
  Description of Artificial Sequence: Synthetic oligonucleotide
ggcgactccggccggagtcgccc

SEQ ID NO: 3384 - DNA, 23 bp, Artificial Sequence
  Description of Artificial Sequence: Synthetic oligonucleotide
ggcgactccggccggagtcgcct

SEQ ID NO: 3385 - DNA, 23 bp, Artificial Sequence
  Description of Artificial Sequence: Synthetic oligonucleotide
agcgactccggccggagtcgctc

SEQ ID NO: 3386 - DNA, 23 bp, Artificial Sequence
  Description of Artificial Sequence: Synthetic oligonucleotide
gacgactccggccggagtcgtcc

SEQ ID NO: 3387 - DNA, 23 bp, Artificial Sequence
  Description of Artificial Sequence: Synthetic oligonucleotide
ggagactccggccggagtctccc

SEQ ID NO: 3388 - DNA, 23 bp, Artificial Sequence
  Description of Artificial Sequence: Synthetic oligonucleotide
ggcgactccggccggagtcgcca

SEQ ID NO: 3389 - DNA, 23 bp, Artificial Sequence
  Description of Artificial Sequence: Synthetic oligonucleotide
tgcgactccggccggagtcgcac

SEQ ID NO: 3390 - DNA, 23 bp, Artificial Sequence
  Description of Artificial Sequence: Synthetic oligonucleotide
ggtgactccggccggagtcaccc

SEQ ID NO: 3391 - DNA, 23 bp, Artificial Sequence
  Description of Artificial Sequence: Synthetic oligonucleotide
cgggactccggccggagtcccgt

SEQ ID NO: 3392 - DNA, 23 bp, Artificial Sequence
  Description of Artificial Sequence: Synthetic oligonucleotide
agggactccggccggagtccctg

SEQ ID NO: 3393 - DNA, 23 bp, Artificial Sequence
  Description of Artificial Sequence: Synthetic oligonucleotide
caggactccggccggagtcctgg

SEQ ID NO: 3394 - DNA, 23 bp, Artificial Sequence
  Description of Artificial Sequence: Synthetic oligonucleotide
cgagactccggccggagtctcgg

SEQ ID NO: 3395 - DNA, 23 bp, Artificial Sequence
  Description of Artificial Sequence: Synthetic oligonucleotide
cgggactccggccggagtcccga

SEQ ID NO: 3396 - DNA, 23 bp, Artificial Sequence
  Description of Artificial Sequence: Synthetic oligonucleotide
tgggactccggccggagtcccag

SEQ ID NO: 3397 - DNA, 23 bp, Artificial Sequence
  Description of Artificial Sequence: Synthetic oligonucleotide
ctggactccggccggagtccagg

SEQ ID NO: 3398 - DNA, 23 bp, Artificial Sequence
  Description of Artificial Sequence: Synthetic oligonucleotide
cgtgactccggccggagtcacgg

SEQ ID NO: 3399 - DNA, 23 bp, Artificial Sequence
  Description of Artificial Sequence: Synthetic oligonucleotide
ggcgactccggccggagtcgccg

SEQ ID NO: 3400 - DNA, 23 bp, Artificial Sequence
  Description of Artificial Sequence: Synthetic oligonucleotide
agcgactccggccggagtcgctg

SEQ ID NO: 3401 - DNA, 23 bp, Artificial Sequence
  Description of Artificial Sequence: Synthetic oligonucleotide
gacgactccggccggagtcgtcg

SEQ ID NO: 3402 - DNA, 23 bp, Artificial Sequence
  Description of Artificial Sequence: Synthetic oligonucleotide
ggagactccggccggagtctccg

SEQ ID NO: 3403 - DNA, 23 bp, Artificial Sequence
  Description of Artificial Sequence: Synthetic oligonucleotide
tgcgactccggccggagtcgcag

SEQ ID NO: 3404 - DNA, 23 bp, Artificial Sequence
  Description of Artificial Sequence: Synthetic oligonucleotide
ggtgactccggccggagtcaccg

SEQ ID NO: 3405 - DNA, 23 bp, Artificial Sequence
  Description of Artificial Sequence: Synthetic oligonucleotide
acggactccggccggagtccgtg

SEQ ID NO: 3406 - DNA, 23 bp, Artificial Sequence
  Description of Artificial Sequence: Synthetic oligonucleotide
ccagactccggccggagtctggg

SEQ ID NO: 3407 - DNA, 23 bp, Artificial Sequence
  Description of Artificial Sequence: Synthetic oligonucleotide
tcggactccggccggagtccgag

SEQ ID NO: 3408 - DNA, 23 bp, Artificial Sequence
  Description of Artificial Sequence: Synthetic oligonucleotide
cctgactccggccggagtcaggg

SEQ ID NO: 3409 - DNA, 23 bp, Artificial Sequence
  Description of Artificial Sequence: Synthetic oligonucleotide
cacgactccggccggagtcgtgg

SEQ ID NO: 3410 - DNA, 23 bp, Artificial Sequence
  Description of Artificial Sequence: Synthetic oligonucleotide
gccgactccggccggagtcggct

SEQ ID NO: 3411 - DNA, 23 bp, Artificial Sequence
  Description of Artificial Sequence: Synthetic oligonucleotide
gccgactccggccggagtcggca

SEQ ID NO: 3412 - DNA, 23 bp, Artificial Sequence
  Description of Artificial Sequence: Synthetic oligonucleotide
cgagactccggccggagtctcgc

SEQ ID NO: 3413 - DNA, 23 bp, Artificial Sequence
  Description of Artificial Sequence: Synthetic oligonucleotide
cgtgactccggccggagtcacgc

SEQ ID NO: 3414 - DNA, 23 bp, Artificial Sequence
  Description of Artificial Sequence: Synthetic oligonucleotide
caggactccggccggagtcctgc

SEQ ID NO: 3415 - DNA, 23 bp, Artificial Sequence
  Description of Artificial Sequence: Synthetic oligonucleotide
ctggactccggccggagtccagc

SEQ ID NO: 3416 - DNA, 23 bp, Artificial Sequence
  Description of Artificial Sequence: Synthetic oligonucleotide
gaggactccggccggagtcctcg

SEQ ID NO: 3417 - DNA, 23 bp, Artificial Sequence
  Description of Artificial Sequence: Synthetic oligonucleotide
gtggactccggccggagtccacg

SEQ ID NO: 3418 - DNA, 23 bp, Artificial Sequence
  Description of Artificial Sequence: Synthetic oligonucleotide
accgactccggccggagtcggtg

SEQ ID NO: 3419 - DNA, 23 bp, Artificial Sequence
  Description of Artificial Sequence: Synthetic oligonucleotide
tccgactccggccggagtcggag

SEQ ID NO: 3420 - DNA, 23 bp, Artificial Sequence
  Description of Artificial Sequence: Synthetic oligonucleotide
cgggactccggccggagtcccgc

SEQ ID NO: 3421 - DNA, 23 bp, Artificial Sequence
  Description of Artificial Sequence: Synthetic oligonucleotide
agggactccggccggagtccctc

SEQ ID NO: 3422 - DNA, 23 bp, Artificial Sequence
  Description of Artificial Sequence: Synthetic oligonucleotide
tgggactccggccggagtcccac

SEQ ID NO: 3423 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccgcgcggagtcnnnn

SEQ ID NO: 3424 - DNA, 23 bp, Artificial Sequence
  Description of Artificial Sequence: Synthetic oligonucleotide
gcggactccgcgcggagtccgcc

SEQ ID NO: 3425 - DNA, 23 bp, Artificial Sequence
  Description of Artificial Sequence: Synthetic oligonucleotide
gcggactccgcgcggagtccgct

SEQ ID NO: 3426 - DNA, 23 bp, Artificial Sequence
  Description of Artificial Sequence: Synthetic oligonucleotide
acggactccgcgcggagtccgtc

SEQ ID NO: 3427 - DNA, 23 bp, Artificial Sequence
  Description of Artificial Sequence: Synthetic oligonucleotide
gaggactccgcgcggagtcctcc

SEQ ID NO: 3428 - DNA, 23 bp, Artificial Sequence
  Description of Artificial Sequence: Synthetic oligonucleotide
gcagactccgcgcggagtctgcc

SEQ ID NO: 3429 - DNA, 23 bp, Artificial Sequence
  Description of Artificial Sequence: Synthetic oligonucleotide
gcggactccgcgcggagtccgca

SEQ ID NO: 3430 - DNA, 23 bp, Artificial Sequence
  Description of Artificial Sequence: Synthetic oligonucleotide
tcggactccgcgcggagtccgac

SEQ ID NO: 3431 - DNA, 23 bp, Artificial Sequence
  Description of Artificial Sequence: Synthetic oligonucleotide
gtggactccgcgcggagtccacc

SEQ ID NO: 3432 - DNA, 23 bp, Artificial Sequence
  Description of Artificial Sequence: Synthetic oligonucleotide
gctgactccgcgcggagtcagcc

SEQ ID NO: 3433 - DNA, 23 bp, Artificial Sequence
  Description of Artificial Sequence: Synthetic oligonucleotide
cccgactccgcgcggagtcgggc

SEQ ID NO: 3434 - DNA, 23 bp, Artificial Sequence
  Description of Artificial Sequence: Synthetic oligonucleotide
cccgactccgcgcggagtcgggt

SEQ ID NO: 3435 - DNA, 23 bp, Artificial Sequence
  Description of Artificial Sequence: Synthetic oligonucleotide
accgactccgcgcggagtcggtc

SEQ ID NO: 3436 - DNA, 23 bp, Artificial Sequence
  Description of Artificial Sequence: Synthetic oligonucleotide
cacgactccgcgcggagtcgtgc

SEQ ID NO: 3437 - DNA, 23 bp, Artificial Sequence
  Description of Artificial Sequence: Synthetic oligonucleotide
ccagactccgcgcggagtctggc

SEQ ID NO: 3438 - DNA, 23 bp, Artificial Sequence
  Description of Artificial Sequence: Synthetic oligonucleotide
cccgactccgcgcggagtcggga

SEQ ID NO: 3439 - DNA, 23 bp, Artificial Sequence
  Description of Artificial Sequence: Synthetic oligonucleotide
tccgactccgcgcggagtcggac

SEQ ID NO: 3440 - DNA, 23 bp, Artificial Sequence
  Description of Artificial Sequence: Synthetic oligonucleotide
cctgactccgcgcggagtcaggc

SEQ ID NO: 3441 - DNA, 23 bp, Artificial Sequence
  Description of Artificial Sequence: Synthetic oligonucleotide
ggcgactccgcgcggagtcgccc

SEQ ID NO: 3442 - DNA, 23 bp, Artificial Sequence
  Description of Artificial Sequence: Synthetic oligonucleotide
ggcgactccgcgcggagtcgcct

SEQ ID NO: 3443 - DNA, 23 bp, Artificial Sequence
  Description of Artificial Sequence: Synthetic oligonucleotide
agcgactccgcgcggagtcgctc

SEQ ID NO: 3444 - DNA, 23 bp, Artificial Sequence
  Description of Artificial Sequence: Synthetic oligonucleotide
gacgactccgcgcggagtcgtcc

SEQ ID NO: 3445 - DNA, 23 bp, Artificial Sequence
  Description of Artificial Sequence: Synthetic oligonucleotide
ggagactccgcgcggagtctccc

SEQ ID NO: 3446 - DNA, 23 bp, Artificial Sequence
  Description of Artificial Sequence: Synthetic oligonucleotide
ggcgactccgcgcggagtcgcca

SEQ ID NO: 3447 - DNA, 23 bp, Artificial Sequence
  Description of Artificial Sequence: Synthetic oligonucleotide
tgcgactccgcgcggagtcgcac

SEQ ID NO: 3448 - DNA, 23 bp, Artificial Sequence
  Description of Artificial Sequence: Synthetic oligonucleotide
ggtgactccgcgcggagtcaccc

SEQ ID NO: 3449 - DNA, 23 bp, Artificial Sequence
  Description of Artificial Sequence: Synthetic oligonucleotide
cgggactccgcgcggagtcccgt

SEQ ID NO: 3450 - DNA, 23 bp, Artificial Sequence
  Description of Artificial Sequence: Synthetic oligonucleotide
agggactccgcgcggagtccctg

SEQ ID NO: 3451 - DNA, 23 bp, Artificial Sequence
  Description of Artificial Sequence: Synthetic oligonucleotide
caggactccgcgcggagtcctgg

SEQ ID NO: 3452 - DNA, 23 bp, Artificial Sequence
  Description of Artificial Sequence: Synthetic oligonucleotide
cgagactccgcgcggagtctcgg

SEQ ID NO: 3453 - DNA, 23 bp, Artificial Sequence
  Description of Artificial Sequence: Synthetic oligonucleotide
cgggactccgcgcggagtcccga

SEQ ID NO: 3454 - DNA, 23 bp, Artificial Sequence
  Description of Artificial Sequence: Synthetic oligonucleotide
tgggactccgcgcggagtcccag

SEQ ID NO: 3455 - DNA, 23 bp, Artificial Sequence
  Description of Artificial Sequence: Synthetic oligonucleotide
ctggactccgcgcggagtccagg

SEQ ID NO: 3456 - DNA, 23 bp, Artificial Sequence
  Description of Artificial Sequence: Synthetic oligonucleotide
cgtgactccgcgcggagtcacgg

SEQ ID NO: 3457 - DNA, 23 bp, Artificial Sequence
  Description of Artificial Sequence: Synthetic oligonucleotide
ggcgactccgcgcggagtcgccg

SEQ ID NO: 3458 - DNA, 23 bp, Artificial Sequence
  Description of Artificial Sequence: Synthetic oligonucleotide
agcgactccgcgcggagtcgctg

SEQ ID NO: 3459 - DNA, 23 bp, Artificial Sequence
  Description of Artificial Sequence: Synthetic oligonucleotide
gacgactccgcgcggagtcgtcg

SEQ ID NO: 3460 - DNA, 23 bp, Artificial Sequence
  Description of Artificial Sequence: Synthetic oligonucleotide
ggagactccgcgcggagtctccg

SEQ ID NO: 3461 - DNA, 23 bp, Artificial Sequence
  Description of Artificial Sequence: Synthetic oligonucleotide
tgcgactccgcgcggagtcgcag

SEQ ID NO: 3462 - DNA, 23 bp, Artificial Sequence
  Description of Artificial Sequence: Synthetic oligonucleotide
ggtgactccgcgcggagtcaccg

SEQ ID NO: 3463 - DNA, 23 bp, Artificial Sequence
  Description of Artificial Sequence: Synthetic oligonucleotide
acggactccgcgcggagtccgtg

SEQ ID NO: 3464 - DNA, 23 bp, Artificial Sequence
  Description of Artificial Sequence: Synthetic oligonucleotide
ccagactccgcgcggagtctggg

SEQ ID NO: 3465 - DNA, 23 bp, Artificial Sequence
  Description of Artificial Sequence: Synthetic oligonucleotide
tcggactccgcgcggagtccgag

SEQ ID NO: 3466 - DNA, 23 bp, Artificial Sequence
  Description of Artificial Sequence: Synthetic oligonucleotide
cctgactccgcgcggagtcaggg

SEQ ID NO: 3467 - DNA, 23 bp, Artificial Sequence
  Description of Artificial Sequence: Synthetic oligonucleotide
cacgactccgcgcggagtcgtgg

SEQ ID NO: 3468 - DNA, 23 bp, Artificial Sequence
  Description of Artificial Sequence: Synthetic oligonucleotide
gccgactccgcgcggagtcggct

SEQ ID NO: 3469 - DNA, 23 bp, Artificial Sequence
  Description of Artificial Sequence: Synthetic oligonucleotide
gccgactccgcgcggagtcggca

SEQ ID NO: 3470 - DNA, 23 bp, Artificial Sequence
  Description of Artificial Sequence: Synthetic oligonucleotide
cgagactccgcgcggagtctcgc

SEQ ID NO: 3471 - DNA, 23 bp, Artificial Sequence
  Description of Artificial Sequence: Synthetic oligonucleotide
cgtgactccgcgcggagtcacgc

SEQ ID NO: 3472 - DNA, 23 bp, Artificial Sequence
  Description of Artificial Sequence: Synthetic oligonucleotide
caggactccgcgcggagtcctgc

SEQ ID NO: 3473 - DNA, 23 bp, Artificial Sequence
  Description of Artificial Sequence: Synthetic oligonucleotide
ctggactccgcgcggagtccagc

SEQ ID NO: 3474 - DNA, 23 bp, Artificial Sequence
  Description of Artificial Sequence: Synthetic oligonucleotide
gaggactccgcgcggagtcctcg

SEQ ID NO: 3475 - DNA, 23 bp, Artificial Sequence
  Description of Artificial Sequence: Synthetic oligonucleotide
gtggactccgcgcggagtccacg

SEQ ID NO: 3476 - DNA, 23 bp, Artificial Sequence
  Description of Artificial Sequence: Synthetic oligonucleotide
accgactccgcgcggagtcggtg

SEQ ID NO: 3477 - DNA, 23 bp, Artificial Sequence
  Description of Artificial Sequence: Synthetic oligonucleotide
tccgactccgcgcggagtcggag

SEQ ID NO: 3478 - DNA, 23 bp, Artificial Sequence
  Description of Artificial Sequence: Synthetic oligonucleotide
cgggactccgcgcggagtcccgc

SEQ ID NO: 3479 - DNA, 23 bp, Artificial Sequence
  Description of Artificial Sequence: Synthetic oligonucleotide
agggactccgcgcggagtccctc

SEQ ID NO: 3480 - DNA, 23 bp, Artificial Sequence
  Description of Artificial Sequence: Synthetic oligonucleotide
tgggactccgcgcggagtcccac

SEQ ID NO: 3481 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctgatcagagtcnnnn

SEQ ID NO: 3482 - DNA, 23 bp, Artificial Sequence
  Description of Artificial Sequence: Synthetic oligonucleotide
gcggactctgatcagagtccgcc

SEQ ID NO: 3483 - DNA, 23 bp, Artificial Sequence
  Description of Artificial Sequence: Synthetic oligonucleotide
gcggactctgatcagagtccgct

SEQ ID NO: 3484 - DNA, 23 bp, Artificial Sequence
  Description of Artificial Sequence: Synthetic oligonucleotide
acggactctgatcagagtccgtc

SEQ ID NO: 3485 - DNA, 23 bp, Artificial Sequence
  Description of Artificial Sequence: Synthetic oligonucleotide
gaggactctgatcagagtcctcc

SEQ ID NO: 3486 - DNA, 23 bp, Artificial Sequence
  Description of Artificial Sequence: Synthetic oligonucleotide
gcagactctgatcagagtctgcc

SEQ ID NO: 3487 - DNA, 23 bp, Artificial Sequence
  Description of Artificial Sequence: Synthetic oligonucleotide
gcggactctgatcagagtccgca

SEQ ID NO: 3488 - DNA, 23 bp, Artificial Sequence
  Description of Artificial Sequence: Synthetic oligonucleotide
tcggactctgatcagagtccgac

SEQ ID NO: 3489 - DNA, 23 bp, Artificial Sequence
  Description of Artificial Sequence: Synthetic oligonucleotide
gtggactctgatcagagtccacc

SEQ ID NO: 3490 - DNA, 23 bp, Artificial Sequence
  Description of Artificial Sequence: Synthetic oligonucleotide
gctgactctgatcagagtcagcc

SEQ ID NO: 3491 - DNA, 23 bp, Artificial Sequence
  Description of Artificial Sequence: Synthetic oligonucleotide
cccgactctgatcagagtcgggc

SEQ ID NO: 3492 - DNA, 23 bp, Artificial Sequence
  Description of Artificial Sequence: Synthetic oligonucleotide
cccgactctgatcagagtcgggt

SEQ ID NO: 3493 - DNA, 23 bp, Artificial Sequence
  Description of Artificial Sequence: Synthetic oligonucleotide
accgactctgatcagagtcggtc

SEQ ID NO: 3494 - DNA, 23 bp, Artificial Sequence
  Description of Artificial Sequence: Synthetic oligonucleotide
cacgactctgatcagagtcgtgc

SEQ ID NO: 3495 - DNA, 23 bp, Artificial Sequence
  Description of Artificial Sequence: Synthetic oligonucleotide
ccagactctgatcagagtctggc

SEQ ID NO: 3496 - DNA, 23 bp, Artificial Sequence
  Description of Artificial Sequence: Synthetic oligonucleotide
cccgactctgatcagagtcggga

SEQ ID NO: 3497 - DNA, 23 bp, Artificial Sequence
  Description of Artificial Sequence: Synthetic oligonucleotide
tccgactctgatcagagtcggac

SEQ ID NO: 3498 - DNA, 23 bp, Artificial Sequence
  Description of Artificial Sequence: Synthetic oligonucleotide
cctgactctgatcagagtcaggc

SEQ ID NO: 3499 - DNA, 23 bp, Artificial Sequence
  Description of Artificial Sequence: Synthetic oligonucleotide
ggcgactctgatcagagtcgccc

SEQ ID NO: 3500 - DNA, 23 bp, Artificial Sequence
  Description of Artificial Sequence: Synthetic oligonucleotide
ggcgactctgatcagagtcgcct

SEQ ID NO: 3501 - DNA, 23 bp, Artificial Sequence
  Description of Artificial Sequence: Synthetic oligonucleotide
agcgactctgatcagagtcgctc

SEQ ID NO: 3502 - DNA, 23 bp, Artificial Sequence
  Description of Artificial Sequence: Synthetic oligonucleotide
gacgactctgatcagagtcgtcc

SEQ ID NO: 3503 - DNA, 23 bp, Artificial Sequence
  Description of Artificial Sequence: Synthetic oligonucleotide
ggagactctgatcagagtctccc

SEQ ID NO: 3504 - DNA, 23 bp, Artificial Sequence
  Description of Artificial Sequence: Synthetic oligonucleotide
ggcgactctgatcagagtcgcca

SEQ ID NO: 3505 - DNA, 23 bp, Artificial Sequence
  Description of Artificial Sequence: Synthetic oligonucleotide
tgcgactctgatcagagtcgcac

SEQ ID NO: 3506 - DNA, 23 bp, Artificial Sequence
  Description of Artificial Sequence: Synthetic oligonucleotide
ggtgactctgatcagagtcaccc

SEQ ID NO: 3507 - DNA, 23 bp, Artificial Sequence
  Description of Artificial Sequence: Synthetic oligonucleotide
cgggactctgatcagagtcccgt

SEQ ID NO: 3508 - DNA, 23 bp, Artificial Sequence
  Description of Artificial Sequence: Synthetic oligonucleotide
agggactctgatcagagtccctg

SEQ ID NO: 3509 - DNA, 23 bp, Artificial Sequence
  Description of Artificial Sequence: Synthetic oligonucleotide
caggactctgatcagagtcctgg

SEQ ID NO: 3510 - DNA, 23 bp, Artificial Sequence
  Description of Artificial Sequence: Synthetic oligonucleotide
cgagactctgatcagagtctcgg

SEQ ID NO: 3511 - DNA, 23 bp, Artificial Sequence
  Description of Artificial Sequence: Synthetic oligonucleotide
cgggactctgatcagagtcccga

SEQ ID NO: 3512 - DNA, 23 bp, Artificial Sequence
  Description of Artificial Sequence: Synthetic oligonucleotide
tgggactctgatcagagtcccag

SEQ ID NO: 3513 - DNA, 23 bp, Artificial Sequence
  Description of Artificial Sequence: Synthetic oligonucleotide
ctggactctgatcagagtccagg

SEQ ID NO: 3514 - DNA, 23 bp, Artificial Sequence
  Description of Artificial Sequence: Synthetic oligonucleotide
cgtgactctgatcagagtcacgg

SEQ ID NO: 3515 - DNA, 23 bp, Artificial Sequence
  Description of Artificial Sequence: Synthetic oligonucleotide
ggcgactctgatcagagtcgccg

SEQ ID NO: 3516 - DNA, 23 bp, Artificial Sequence
  Description of Artificial Sequence: Synthetic oligonucleotide
agcgactctgatcagagtcgctg

SEQ ID NO: 3517 - DNA, 23 bp, Artificial Sequence
  Description of Artificial Sequence: Synthetic oligonucleotide
gacgactctgatcagagtcgtcg

SEQ ID NO: 3518 - DNA, 23 bp, Artificial Sequence
  Description of Artificial Sequence: Synthetic oligonucleotide
ggagactctgatcagagtctccg

SEQ ID NO: 3519 - DNA, 23 bp, Artificial Sequence
  Description of Artificial Sequence: Synthetic oligonucleotide
tgcgactctgatcagagtcgcag

SEQ ID NO: 3520 - DNA, 23 bp, Artificial Sequence
  Description of Artificial Sequence: Synthetic oligonucleotide
ggtgactctgatcagagtcaccg

SEQ ID NO: 3521 - DNA, 23 bp, Artificial Sequence
  Description of Artificial Sequence: Synthetic oligonucleotide
acggactctgatcagagtccgtg

SEQ ID NO: 3522 - DNA, 23 bp, Artificial Sequence
  Description of Artificial Sequence: Synthetic oligonucleotide
ccagactctgatcagagtctggg

SEQ ID NO: 3523 - DNA, 23 bp, Artificial Sequence
  Description of Artificial Sequence: Synthetic oligonucleotide
tcggactctgatcagagtccgag

SEQ ID NO: 3524 - DNA, 23 bp, Artificial Sequence
  Description of Artificial Sequence: Synthetic oligonucleotide
cctgactctgatcagagtcaggg

SEQ ID NO: 3525 - DNA, 23 bp, Artificial Sequence
  Description of Artificial Sequence: Synthetic oligonucleotide
cacgactctgatcagagtcgtgg

SEQ ID NO: 3526 - DNA, 23 bp, Artificial Sequence
  Description of Artificial Sequence: Synthetic oligonucleotide
gccgactctgatcagagtcggct

SEQ ID NO: 3527 - DNA, 23 bp, Artificial Sequence
  Description of Artificial Sequence: Synthetic oligonucleotide
gccgactctgatcagagtcggca

SEQ ID NO: 3528 - DNA, 23 bp, Artificial Sequence
  Description of Artificial Sequence: Synthetic oligonucleotide
cgagactctgatcagagtctcgc

SEQ ID NO: 3529 - DNA, 23 bp, Artificial Sequence
  Description of Artificial Sequence: Synthetic oligonucleotide
cgtgactctgatcagagtcacgc

SEQ ID NO: 3530 - DNA, 23 bp, Artificial Sequence
  Description of Artificial Sequence: Synthetic oligonucleotide
caggactctgatcagagtcctgc

SEQ ID NO: 3531 - DNA, 23 bp, Artificial Sequence
  Description of Artificial Sequence: Synthetic oligonucleotide
ctggactctgatcagagtccagc

SEQ ID NO: 3532 - DNA, 23 bp, Artificial Sequence
  Description of Artificial Sequence: Synthetic oligonucleotide
gaggactctgatcagagtcctcg

SEQ ID NO: 3533 - DNA, 23 bp, Artificial Sequence
  Description of Artificial Sequence: Synthetic oligonucleotide
gtggactctgatcagagtccacg

SEQ ID NO: 3534 - DNA, 23 bp, Artificial Sequence
  Description of Artificial Sequence: Synthetic oligonucleotide
accgactctgatcagagtcggtg

SEQ ID NO: 3535 - DNA, 23 bp, Artificial Sequence
  Description of Artificial Sequence: Synthetic oligonucleotide
tccgactctgatcagagtcggag

SEQ ID NO: 3536 - DNA, 23 bp, Artificial Sequence
  Description of Artificial Sequence: Synthetic oligonucleotide
cgggactctgatcagagtcccgc

SEQ ID NO: 3537 - DNA, 23 bp, Artificial Sequence
  Description of Artificial Sequence: Synthetic oligonucleotide
agggactctgatcagagtccctc

SEQ ID NO: 3538 - DNA, 23 bp, Artificial Sequence
  Description of Artificial Sequence: Synthetic oligonucleotide
tgggactctgatcagagtcccac

SEQ ID NO: 3539 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctgtacagagtcnnnn

SEQ ID NO: 3540 - DNA, 23 bp, Artificial Sequence
  Description of Artificial Sequence: Synthetic oligonucleotide
gcggactctgtacagagtccgcc

SEQ ID NO: 3541 - DNA, 23 bp, Artificial Sequence
  Description of Artificial Sequence: Synthetic oligonucleotide
gcggactctgtacagagtccgct

SEQ ID NO: 3542 - DNA, 23 bp, Artificial Sequence
  Description of Artificial Sequence: Synthetic oligonucleotide
acggactctgtacagagtccgtc

SEQ ID NO: 3543 - DNA, 23 bp, Artificial Sequence
  Description of Artificial Sequence: Synthetic oligonucleotide
gaggactctgtacagagtcctcc

SEQ ID NO: 3544 - DNA, 23 bp, Artificial Sequence
  Description of Artificial Sequence: Synthetic oligonucleotide
gcagactctgtacagagtctgcc

SEQ ID NO: 3545 - DNA, 23 bp, Artificial Sequence
  Description of Artificial Sequence: Synthetic oligonucleotide
gcggactctgtacagagtccgca

SEQ ID NO: 3546 - DNA, 23 bp, Artificial Sequence
  Description of Artificial Sequence: Synthetic oligonucleotide
tcggactctgtacagagtccgac

SEQ ID NO: 3547 - DNA, 23 bp, Artificial Sequence
  Description of Artificial Sequence: Synthetic oligonucleotide
gtggactctgtacagagtccacc

SEQ ID NO: 3548 - DNA, 23 bp, Artificial Sequence
  Description of Artificial Sequence: Synthetic oligonucleotide
gctgactctgtacagagtcagcc

SEQ ID NO: 3549 - DNA, 23 bp, Artificial Sequence
  Description of Artificial Sequence: Synthetic oligonucleotide
cccgactctgtacagagtcgggc

SEQ ID NO: 3550 - DNA, 23 bp, Artificial Sequence
  Description of Artificial Sequence: Synthetic oligonucleotide
cccgactctgtacagagtcgggt

SEQ ID NO: 3551 - DNA, 23 bp, Artificial Sequence
  Description of Artificial Sequence: Synthetic oligonucleotide
accgactctgtacagagtcggtc

SEQ ID NO: 3552 - DNA, 23 bp, Artificial Sequence
  Description of Artificial Sequence: Synthetic oligonucleotide
cacgactctgtacagagtcgtgc

SEQ ID NO: 3553 - DNA, 23 bp, Artificial Sequence
  Description of Artificial Sequence: Synthetic oligonucleotide
ccagactctgtacagagtctggc

SEQ ID NO: 3554 - DNA, 23 bp, Artificial Sequence
  Description of Artificial Sequence: Synthetic oligonucleotide
cccgactctgtacagagtcggga

SEQ ID NO: 3555 - DNA, 23 bp, Artificial Sequence
  Description of Artificial Sequence: Synthetic oligonucleotide
tccgactctgtacagagtcggac

SEQ ID NO: 3556 - DNA, 23 bp, Artificial Sequence
  Description of Artificial Sequence: Synthetic oligonucleotide
cctgactctgtacagagtcaggc

SEQ ID NO: 3557 - DNA, 23 bp, Artificial Sequence
  Description of Artificial Sequence: Synthetic oligonucleotide
ggcgactctgtacagagtcgccc

SEQ ID NO: 3558 - DNA, 23 bp, Artificial Sequence
  Description of Artificial Sequence: Synthetic oligonucleotide
ggcgactctgtacagagtcgcct

SEQ ID NO: 3559 - DNA, 23 bp, Artificial Sequence
  Description of Artificial Sequence: Synthetic oligonucleotide
agcgactctgtacagagtcgctc

SEQ ID NO: 3560 - DNA, 23 bp, Artificial Sequence
  Description of Artificial Sequence: Synthetic oligonucleotide
gacgactctgtacagagtcgtcc

SEQ ID NO: 3561 - DNA, 23 bp, Artificial Sequence
  Description of Artificial Sequence: Synthetic oligonucleotide
ggagactctgtacagagtctccc

SEQ ID NO: 3562 - DNA, 23 bp, Artificial Sequence
  Description of Artificial Sequence: Synthetic oligonucleotide
ggcgactctgtacagagtcgcca

SEQ ID NO: 3563 - DNA, 23 bp, Artificial Sequence
  Description of Artificial Sequence: Synthetic oligonucleotide
tgcgactctgtacagagtcgcac

SEQ ID NO: 3564 - DNA, 23 bp, Artificial Sequence
  Description of Artificial Sequence: Synthetic oligonucleotide
ggtgactctgtacagagtcaccc

SEQ ID NO: 3565 - DNA, 23 bp, Artificial Sequence
  Description of Artificial Sequence: Synthetic oligonucleotide
cgggactctgtacagagtcccgt

SEQ ID NO: 3566 - DNA, 23 bp, Artificial Sequence
  Description of Artificial Sequence: Synthetic oligonucleotide
agggactctgtacagagtccctg

SEQ ID NO: 3567 - DNA, 23 bp, Artificial Sequence
  Description of Artificial Sequence: Synthetic oligonucleotide
caggactctgtacagagtcctgg

SEQ ID NO: 3568 - DNA, 23 bp, Artificial Sequence
  Description of Artificial Sequence: Synthetic oligonucleotide
cgagactctgtacagagtctcgg

SEQ ID NO: 3569 - DNA, 23 bp, Artificial Sequence
  Description of Artificial Sequence: Synthetic oligonucleotide
cgggactctgtacagagtcccga

SEQ ID NO: 3570 - DNA, 23 bp, Artificial Sequence
  Description of Artificial Sequence: Synthetic oligonucleotide
tgggactctgtacagagtcccag

SEQ ID NO: 3571 - DNA, 23 bp, Artificial Sequence
  Description of Artificial Sequence: Synthetic oligonucleotide
ctggactctgtacagagtccagg

SEQ ID NO: 3572 - DNA, 23 bp, Artificial Sequence
  Description of Artificial Sequence: Synthetic oligonucleotide
cgtgactctgtacagagtcacgg

SEQ ID NO: 3573 - DNA, 23 bp, Artificial Sequence
  Description of Artificial Sequence: Synthetic oligonucleotide
ggcgactctgtacagagtcgccg

SEQ ID NO: 3574 - DNA, 23 bp, Artificial Sequence
  Description of Artificial Sequence: Synthetic oligonucleotide
agcgactctgtacagagtcgctg

SEQ ID NO: 3575 - DNA, 23 bp, Artificial Sequence
  Description of Artificial Sequence: Synthetic oligonucleotide
gacgactctgtacagagtcgtcg

SEQ ID NO: 3576 - DNA, 23 bp, Artificial Sequence
  Description of Artificial Sequence: Synthetic oligonucleotide
ggagactctgtacagagtctccg

SEQ ID NO: 3577 - DNA, 23 bp, Artificial Sequence
  Description of Artificial Sequence: Synthetic oligonucleotide
tgcgactctgtacagagtcgcag

SEQ ID NO: 3578 - DNA, 23 bp, Artificial Sequence
  Description of Artificial Sequence: Synthetic oligonucleotide
ggtgactctgtacagagtcaccg

SEQ ID NO: 3579 - DNA, 23 bp, Artificial Sequence
  Description of Artificial Sequence: Synthetic oligonucleotide
acggactctgtacagagtccgtg

SEQ ID NO: 3580 - DNA, 23 bp, Artificial Sequence
  Description of Artificial Sequence: Synthetic oligonucleotide
ccagactctgtacagagtctggg

SEQ ID NO: 3581 - DNA, 23 bp, Artificial Sequence
  Description of Artificial Sequence: Synthetic oligonucleotide
tcggactctgtacagagtccgag

SEQ ID NO: 3582 - DNA, 23 bp, Artificial Sequence
  Description of Artificial Sequence: Synthetic oligonucleotide
cctgactctgtacagagtcaggg

SEQ ID NO: 3583 - DNA, 23 bp, Artificial Sequence
  Description of Artificial Sequence: Synthetic oligonucleotide
cacgactctgtacagagtcgtgg

SEQ ID NO: 3584 - DNA, 23 bp, Artificial Sequence
  Description of Artificial Sequence: Synthetic oligonucleotide
gccgactctgtacagagtcggct

SEQ ID NO: 3585 - DNA, 23 bp, Artificial Sequence
  Description of Artificial Sequence: Synthetic oligonucleotide
gccgactctgtacagagtcggca

SEQ ID NO: 3586 - DNA, 23 bp, Artificial Sequence
  Description of Artificial Sequence: Synthetic oligonucleotide
cgagactctgtacagagtctcgc

SEQ ID NO: 3587 - DNA, 23 bp, Artificial Sequence
  Description of Artificial Sequence: Synthetic oligonucleotide
cgtgactctgtacagagtcacgc

SEQ ID NO: 3588 - DNA, 23 bp, Artificial Sequence
  Description of Artificial Sequence: Synthetic oligonucleotide
caggactctgtacagagtcctgc

SEQ ID NO: 3589 - DNA, 23 bp, Artificial Sequence
  Description of Artificial Sequence: Synthetic oligonucleotide
ctggactctgtacagagtccagc

SEQ ID NO: 3590 - DNA, 23 bp, Artificial Sequence
  Description of Artificial Sequence: Synthetic oligonucleotide
gaggactctgtacagagtcctcg

SEQ ID NO: 3591 - DNA, 23 bp, Artificial Sequence
  Description of Artificial Sequence: Synthetic oligonucleotide
gtggactctgtacagagtccacg

SEQ ID NO: 3592 - DNA, 23 bp, Artificial Sequence
  Description of Artificial Sequence: Synthetic oligonucleotide
accgactctgtacagagtcggtg

SEQ ID NO: 3593 - DNA, 23 bp, Artificial Sequence
  Description of Artificial Sequence: Synthetic oligonucleotide
tccgactctgtacagagtcggag

SEQ ID NO: 3594 - DNA, 23 bp, Artificial Sequence
  Description of Artificial Sequence: Synthetic oligonucleotide
cgggactctgtacagagtcccgc

SEQ ID NO: 3595 - DNA, 23 bp, Artificial Sequence
  Description of Artificial Sequence: Synthetic oligonucleotide
agggactctgtacagagtccctc

SEQ ID NO: 3596 - DNA, 23 bp, Artificial Sequence
  Description of Artificial Sequence: Synthetic oligonucleotide
tgggactctgtacagagtcccac

SEQ ID NO: 3597 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctggccagagtcnnnn

SEQ ID NO: 3598 - DNA, 23 bp, Artificial Sequence
  Description of Artificial Sequence: Synthetic oligonucleotide
gcggactctggccagagtccgcc

SEQ ID NO: 3599 - DNA, 23 bp, Artificial Sequence
  Description of Artificial Sequence: Synthetic oligonucleotide
gcggactctggccagagtccgct

SEQ ID NO: 3600 - DNA, 23 bp, Artificial Sequence
  Description of Artificial Sequence: Synthetic oligonucleotide
acggactctggccagagtccgtc

SEQ ID NO: 3601 - DNA, 23 bp, Artificial Sequence
  Description of Artificial Sequence: Synthetic oligonucleotide
gaggactctggccagagtcctcc

SEQ ID NO: 3602 - DNA, 23 bp, Artificial Sequence
  Description of Artificial Sequence: Synthetic oligonucleotide
gcagactctggccagagtctgcc

SEQ ID NO: 3603 - DNA, 23 bp, Artificial Sequence
  Description of Artificial Sequence: Synthetic oligonucleotide
gcggactctggccagagtccgca

SEQ ID NO: 3604 - DNA, 23 bp, Artificial Sequence
  Description of Artificial Sequence: Synthetic oligonucleotide
tcggactctggccagagtccgac

SEQ ID NO: 3605 - DNA, 23 bp, Artificial Sequence
  Description of Artificial Sequence: Synthetic oligonucleotide
gtggactctggccagagtccacc

SEQ ID NO: 3606 - DNA, 23 bp, Artificial Sequence
  Description of Artificial Sequence: Synthetic oligonucleotide
gctgactctggccagagtcagcc

SEQ ID NO: 3607 - DNA, 23 bp, Artificial Sequence
  Description of Artificial Sequence: Synthetic oligonucleotide
cccgactctggccagagtcgggc

SEQ ID NO: 3608 - DNA, 23 bp, Artificial Sequence
  Description of Artificial Sequence: Synthetic oligonucleotide
cccgactctggccagagtcgggt

SEQ ID NO: 3609 - DNA, 23 bp, Artificial Sequence
  Description of Artificial Sequence: Synthetic oligonucleotide
accgactctggccagagtcggtc

SEQ ID NO: 3610 - DNA, 23 bp, Artificial Sequence
  Description of Artificial Sequence: Synthetic oligonucleotide
cacgactctggccagagtcgtgc

SEQ ID NO: 3611 - DNA, 23 bp, Artificial Sequence
  Description of Artificial Sequence: Synthetic oligonucleotide
ccagactctggccagagtctggc

SEQ ID NO: 3612 - DNA, 23 bp, Artificial Sequence
  Description of Artificial Sequence: Synthetic oligonucleotide
cccgactctggccagagtcggga

SEQ ID NO: 3613 - DNA, 23 bp, Artificial Sequence
  Description of Artificial Sequence: Synthetic oligonucleotide
tccgactctggccagagtcggac

SEQ ID NO: 3614 - DNA, 23 bp, Artificial Sequence
  Description of Artificial Sequence: Synthetic oligonucleotide
cctgactctggccagagtcaggc

SEQ ID NO: 3615 - DNA, 23 bp, Artificial Sequence
  Description of Artificial Sequence: Synthetic oligonucleotide
ggcgactctggccagagtcgccc

SEQ ID NO: 3616 - DNA, 23 bp, Artificial Sequence
  Description of Artificial Sequence: Synthetic oligonucleotide
ggcgactctggccagagtcgcct

SEQ ID NO: 3617 - DNA, 23 bp, Artificial Sequence
  Description of Artificial Sequence: Synthetic oligonucleotide
agcgactctggccagagtcgctc

SEQ ID NO: 3618 - DNA, 23 bp, Artificial Sequence
  Description of Artificial Sequence: Synthetic oligonucleotide
gacgactctggccagagtcgtcc

SEQ ID NO: 3619 - DNA, 23 bp, Artificial Sequence
  Description of Artificial Sequence: Synthetic oligonucleotide
ggagactctggccagagtctccc

SEQ ID NO: 3620 - DNA, 23 bp, Artificial Sequence
  Description of Artificial Sequence: Synthetic oligonucleotide
ggcgactctggccagagtcgcca

SEQ ID NO: 3621 - DNA, 23 bp, Artificial Sequence
  Description of Artificial Sequence: Synthetic oligonucleotide
tgcgactctggccagagtcgcac

SEQ ID NO: 3622 - DNA, 23 bp, Artificial Sequence
  Description of Artificial Sequence: Synthetic oligonucleotide
ggtgactctggccagagtcaccc

SEQ ID NO: 3623 - DNA, 23 bp, Artificial Sequence
  Description of Artificial Sequence: Synthetic oligonucleotide
cgggactctggccagagtcccgt

SEQ ID NO: 3624 - DNA, 23 bp, Artificial Sequence
  Description of Artificial Sequence: Synthetic oligonucleotide
agggactctggccagagtccctg

SEQ ID NO: 3625 - DNA, 23 bp, Artificial Sequence
  Description of Artificial Sequence: Synthetic oligonucleotide
caggactctggccagagtcctgg

SEQ ID NO: 3626 - DNA, 23 bp, Artificial Sequence
  Description of Artificial Sequence: Synthetic oligonucleotide
cgagactctggccagagtctcgg

SEQ ID NO: 3627 - DNA, 23 bp, Artificial Sequence
  Description of Artificial Sequence: Synthetic oligonucleotide
cgggactctggccagagtcccga

SEQ ID NO: 3628 - DNA, 23 bp, Artificial Sequence
  Description of Artificial Sequence: Synthetic oligonucleotide
tgggactctggccagagtcccag

SEQ ID NO: 3629 - DNA, 23 bp, Artificial Sequence
  Description of Artificial Sequence: Synthetic oligonucleotide
ctggactctggccagagtccagg

SEQ ID NO: 3630 - DNA, 23 bp, Artificial Sequence
  Description of Artificial Sequence: Synthetic oligonucleotide
cgtgactctggccagagtcacgg

SEQ ID NO: 3631 - DNA, 23 bp, Artificial Sequence
  Description of Artificial Sequence: Synthetic oligonucleotide
ggcgactctggccagagtcgccg

SEQ ID NO: 3632 - DNA, 23 bp, Artificial Sequence
  Description of Artificial Sequence: Synthetic oligonucleotide
agcgactctggccagagtcgctg

SEQ ID NO: 3633 - DNA, 23 bp, Artificial Sequence
  Description of Artificial Sequence: Synthetic oligonucleotide
gacgactctggccagagtcgtcg

SEQ ID NO: 3634 - DNA, 23 bp, Artificial Sequence
  Description of Artificial Sequence: Synthetic oligonucleotide
ggagactctggccagagtctccg

SEQ ID NO: 3635 - DNA, 23 bp, Artificial Sequence
  Description of Artificial Sequence: Synthetic oligonucleotide
tgcgactctggccagagtcgcag

SEQ ID NO: 3636 - DNA, 23 bp, Artificial Sequence
  Description of Artificial Sequence: Synthetic oligonucleotide
ggtgactctggccagagtcaccg

SEQ ID NO: 3637 - DNA, 23 bp, Artificial Sequence
  Description of Artificial Sequence: Synthetic oligonucleotide
acggactctggccagagtccgtg

SEQ ID NO: 3638 - DNA, 23 bp, Artificial Sequence
  Description of Artificial Sequence: Synthetic oligonucleotide
ccagactctggccagagtctggg

SEQ ID NO: 3639 - DNA, 23 bp, Artificial Sequence
  Description of Artificial Sequence: Synthetic oligonucleotide
tcggactctggccagagtccgag

SEQ ID NO: 3640 - DNA, 23 bp, Artificial Sequence
  Description of Artificial Sequence: Synthetic oligonucleotide
cctgactctggccagagtcaggg

SEQ ID NO: 3641 - DNA, 23 bp, Artificial Sequence
  Description of Artificial Sequence: Synthetic oligonucleotide
cacgactctggccagagtcgtgg

SEQ ID NO: 3642 - DNA, 23 bp, Artificial Sequence
  Description of Artificial Sequence: Synthetic oligonucleotide
gccgactctggccagagtcggct

SEQ ID NO: 3643 - DNA, 23 bp, Artificial Sequence
  Description of Artificial Sequence: Synthetic oligonucleotide
gccgactctggccagagtcggca

SEQ ID NO: 3644 - DNA, 23 bp, Artificial Sequence
  Description of Artificial Sequence: Synthetic oligonucleotide
cgagactctggccagagtctcgc

SEQ ID NO: 3645 - DNA, 23 bp, Artificial Sequence
  Description of Artificial Sequence: Synthetic oligonucleotide
cgtgactctggccagagtcacgc

SEQ ID NO: 3646 - DNA, 23 bp, Artificial Sequence
  Description of Artificial Sequence: Synthetic oligonucleotide
caggactctggccagagtcctgc

SEQ ID NO: 3647 - DNA, 23 bp, Artificial Sequence
  Description of Artificial Sequence: Synthetic oligonucleotide
ctggactctggccagagtccagc

SEQ ID NO: 3648 - DNA, 23 bp, Artificial Sequence
  Description of Artificial Sequence: Synthetic oligonucleotide
gaggactctggccagagtcctcg

SEQ ID NO: 3649 - DNA, 23 bp, Artificial Sequence
  Description of Artificial Sequence: Synthetic oligonucleotide
gtggactctggccagagtccacg

SEQ ID NO: 3650 - DNA, 23 bp, Artificial Sequence
  Description of Artificial Sequence: Synthetic oligonucleotide
accgactctggccagagtcggtg

SEQ ID NO: 3651 - DNA, 23 bp, Artificial Sequence
  Description of Artificial Sequence: Synthetic oligonucleotide
tccgactctggccagagtcggag

SEQ ID NO: 3652 - DNA, 23 bp, Artificial Sequence
  Description of Artificial Sequence: Synthetic oligonucleotide
cgggactctggccagagtcccgc

SEQ ID NO: 3653 - DNA, 23 bp, Artificial Sequence
  Description of Artificial Sequence: Synthetic oligonucleotide
agggactctggccagagtccctc

SEQ ID NO: 3654 - DNA, 23 bp, Artificial Sequence
  Description of Artificial Sequence: Synthetic oligonucleotide
tgggactctggccagagtcccac

SEQ ID NO: 3655 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctgcgcagagtcnnnn

SEQ ID NO: 3656 - DNA, 23 bp, Artificial Sequence
  Description of Artificial Sequence: Synthetic oligonucleotide
gcggactctgcgcagagtccgcc

SEQ ID NO: 3657 - DNA, 23 bp, Artificial Sequence
  Description of Artificial Sequence: Synthetic oligonucleotide
gcggactctgcgcagagtccgct

SEQ ID NO: 3658 - DNA, 23 bp, Artificial Sequence
  Description of Artificial Sequence: Synthetic oligonucleotide
acggactctgcgcagagtccgtc

SEQ ID NO: 3659 - DNA, 23 bp, Artificial Sequence
  Description of Artificial Sequence: Synthetic oligonucleotide
gaggactctgcgcagagtcctcc

SEQ ID NO: 3660 - DNA, 23 bp, Artificial Sequence
  Description of Artificial Sequence: Synthetic oligonucleotide
gcagactctgcgcagagtctgcc

SEQ ID NO: 3661 - DNA, 23 bp, Artificial Sequence
  Description of Artificial Sequence: Synthetic oligonucleotide
gcggactctgcgcagagtccgca

SEQ ID NO: 3662 - DNA, 23 bp, Artificial Sequence
  Description of Artificial Sequence: Synthetic oligonucleotide
tcggactctgcgcagagtccgac

SEQ ID NO: 3663 - DNA, 23 bp, Artificial Sequence
  Description of Artificial Sequence: Synthetic oligonucleotide
gtggactctgcgcagagtccacc

SEQ ID NO: 3664 - DNA, 23 bp, Artificial Sequence
  Description of Artificial Sequence: Synthetic oligonucleotide
gctgactctgcgcagagtcagcc

SEQ ID NO: 3665 - DNA, 23 bp, Artificial Sequence
  Description of Artificial Sequence: Synthetic oligonucleotide
cccgactctgcgcagagtcgggc

SEQ ID NO: 3666 - DNA, 23 bp, Artificial Sequence
  Description of Artificial Sequence: Synthetic oligonucleotide
cccgactctgcgcagagtcgggt

SEQ ID NO: 3667 - DNA, 23 bp, Artificial Sequence
  Description of Artificial Sequence: Synthetic oligonucleotide
accgactctgcgcagagtcggtc

SEQ ID NO: 3668 - DNA, 23 bp, Artificial Sequence
  Description of Artificial Sequence: Synthetic oligonucleotide
cacgactctgcgcagagtcgtgc

SEQ ID NO: 3669 - DNA, 23 bp, Artificial Sequence
  Description of Artificial Sequence: Synthetic oligonucleotide
ccagactctgcgcagagtctggc

SEQ ID NO: 3670 - DNA, 23 bp, Artificial Sequence
  Description of Artificial Sequence: Synthetic oligonucleotide
cccgactctgcgcagagtcggga

SEQ ID NO: 3671 - DNA, 23 bp, Artificial Sequence
  Description of Artificial Sequence: Synthetic oligonucleotide
tccgactctgcgcagagtcggac

SEQ ID NO: 3672 - DNA, 23 bp, Artificial Sequence
  Description of Artificial Sequence: Synthetic oligonucleotide
cctgactctgcgcagagtcaggc

SEQ ID NO: 3673 - DNA, 23 bp, Artificial Sequence
  Description of Artificial Sequence: Synthetic oligonucleotide
ggcgactctgcgcagagtcgccc

SEQ ID NO: 3674 - DNA, 23 bp, Artificial Sequence
  Description of Artificial Sequence: Synthetic oligonucleotide
ggcgactctgcgcagagtcgcct

SEQ ID NO: 3675 - DNA, 23 bp, Artificial Sequence
  Description of Artificial Sequence: Synthetic oligonucleotide
agcgactctgcgcagagtcgctc

SEQ ID NO: 3676 - DNA, 23 bp, Artificial Sequence
  Description of Artificial Sequence: Synthetic oligonucleotide
gacgactctgcgcagagtcgtcc

SEQ ID NO: 3677 - DNA, 23 bp, Artificial Sequence
  Description of Artificial Sequence: Synthetic oligonucleotide
ggagactctgcgcagagtctccc

SEQ ID NO: 3678 - DNA, 23 bp, Artificial Sequence
  Description of Artificial Sequence: Synthetic oligonucleotide
ggcgactctgcgcagagtcgcca

SEQ ID NO: 3679 - DNA, 23 bp, Artificial Sequence
  Description of Artificial Sequence: Synthetic oligonucleotide
tgcgactctgcgcagagtcgcac

SEQ ID NO: 3680 - DNA, 23 bp, Artificial Sequence
  Description of Artificial Sequence: Synthetic oligonucleotide
ggtgactctgcgcagagtcaccc

SEQ ID NO: 3681 - DNA, 23 bp, Artificial Sequence
  Description of Artificial Sequence: Synthetic oligonucleotide
cgggactctgcgcagagtcccgt

SEQ ID NO: 3682 - DNA, 23 bp, Artificial Sequence
  Description of Artificial Sequence: Synthetic oligonucleotide
agggactctgcgcagagtccctg

SEQ ID NO: 3683 - DNA, 23 bp, Artificial Sequence
  Description of Artificial Sequence: Synthetic oligonucleotide
caggactctgcgcagagtcctgg

SEQ ID NO: 3684 - DNA, 23 bp, Artificial Sequence
  Description of Artificial Sequence: Synthetic oligonucleotide
cgagactctgcgcagagtctcgg

SEQ ID NO: 3685 - DNA, 23 bp, Artificial Sequence
  Description of Artificial Sequence: Synthetic oligonucleotide
cgggactctgcgcagagtcccga

SEQ ID NO: 3686 - DNA, 23 bp, Artificial Sequence
  Description of Artificial Sequence: Synthetic oligonucleotide
tgggactctgcgcagagtcccag

SEQ ID NO: 3687 - DNA, 23 bp, Artificial Sequence
  Description of Artificial Sequence: Synthetic oligonucleotide
ctggactctgcgcagagtccagg

SEQ ID NO: 3688 - DNA, 23 bp, Artificial Sequence
  Description of Artificial Sequence: Synthetic oligonucleotide
cgtgactctgcgcagagtcacgg

SEQ ID NO: 3689 - DNA, 23 bp, Artificial Sequence
  Description of Artificial Sequence: Synthetic oligonucleotide
ggcgactctgcgcagagtcgccg

SEQ ID NO: 3690 - DNA, 23 bp, Artificial Sequence
  Description of Artificial Sequence: Synthetic oligonucleotide
agcgactctgcgcagagtcgctg

SEQ ID NO: 3691 - DNA, 23 bp, Artificial Sequence
  Description of Artificial Sequence: Synthetic oligonucleotide
gacgactctgcgcagagtcgtcg

SEQ ID NO: 3692 - DNA, 23 bp, Artificial Sequence
  Description of Artificial Sequence: Synthetic oligonucleotide
ggagactctgcgcagagtctccg

SEQ ID NO: 3693 - DNA, 23 bp, Artificial Sequence
  Description of Artificial Sequence: Synthetic oligonucleotide
tgcgactctgcgcagagtcgcag

SEQ ID NO: 3694 - DNA, 23 bp, Artificial Sequence
  Description of Artificial Sequence: Synthetic oligonucleotide
ggtgactctgcgcagagtcaccg

SEQ ID NO: 3695 - DNA, 23 bp, Artificial Sequence
  Description of Artificial Sequence: Synthetic oligonucleotide
acggactctgcgcagagtccgtg

SEQ ID NO: 3696 - DNA, 23 bp, Artificial Sequence
  Description of Artificial Sequence: Synthetic oligonucleotide
ccagactctgcgcagagtctggg

SEQ ID NO: 3697 - DNA, 23 bp, Artificial Sequence
  Description of Artificial Sequence: Synthetic oligonucleotide
tcggactctgcgcagagtccgag

SEQ ID NO: 3698 - DNA, 23 bp, Artificial Sequence
  Description of Artificial Sequence: Synthetic oligonucleotide
cctgactctgcgcagagtcaggg

SEQ ID NO: 3699 - DNA, 23 bp, Artificial Sequence
  Description of Artificial Sequence: Synthetic oligonucleotide
cacgactctgcgcagagtcgtgg

SEQ ID NO: 3700 - DNA, 23 bp, Artificial Sequence
  Description of Artificial Sequence: Synthetic oligonucleotide
gccgactctgcgcagagtcggct

SEQ ID NO: 3701 - DNA, 23 bp, Artificial Sequence
  Description of Artificial Sequence: Synthetic oligonucleotide
gccgactctgcgcagagtcggca

SEQ ID NO: 3702 - DNA, 23 bp, Artificial Sequence
  Description of Artificial Sequence: Synthetic oligonucleotide
cgagactctgcgcagagtctcgc

SEQ ID NO: 3703 - DNA, 23 bp, Artificial Sequence
  Description of Artificial Sequence: Synthetic oligonucleotide
cgtgactctgcgcagagtcacgc

SEQ ID NO: 3704 - DNA, 23 bp, Artificial Sequence
  Description of Artificial Sequence: Synthetic oligonucleotide
caggactctgcgcagagtcctgc

SEQ ID NO: 3705 - DNA, 23 bp, Artificial Sequence
  Description of Artificial Sequence: Synthetic oligonucleotide
ctggactctgcgcagagtccagc

SEQ ID NO: 3706 - DNA, 23 bp, Artificial Sequence
  Description of Artificial Sequence: Synthetic oligonucleotide
gaggactctgcgcagagtcctcg

SEQ ID NO: 3707 - DNA, 23 bp, Artificial Sequence
  Description of Artificial Sequence: Synthetic oligonucleotide
gtggactctgcgcagagtccacg

SEQ ID NO: 3708 - DNA, 23 bp, Artificial Sequence
  Description of Artificial Sequence: Synthetic oligonucleotide
accgactctgcgcagagtcggtg

SEQ ID NO: 3709 - DNA, 23 bp, Artificial Sequence
  Description of Artificial Sequence: Synthetic oligonucleotide
tccgactctgcgcagagtcggag

SEQ ID NO: 3710 - DNA, 23 bp, Artificial Sequence
  Description of Artificial Sequence: Synthetic oligonucleotide
cgggactctgcgcagagtcccgc

SEQ ID NO: 3711 - DNA, 23 bp, Artificial Sequence
  Description of Artificial Sequence: Synthetic oligonucleotide
agggactctgcgcagagtccctc

SEQ ID NO: 3712 - DNA, 23 bp, Artificial Sequence
  Description of Artificial Sequence: Synthetic oligonucleotide
tgggactctgcgcagagtcccac

SEQ ID NO: 3713 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgcatgcgagtcnnnn

SEQ ID NO: 3714 - DNA, 23 bp, Artificial Sequence
  Description of Artificial Sequence: Synthetic oligonucleotide
gcggactcgcatgcgagtccgcc

SEQ ID NO: 3715 - DNA, 23 bp, Artificial Sequence
  Description of Artificial Sequence: Synthetic oligonucleotide
gcggactcgcatgcgagtccgct

SEQ ID NO: 3716 - DNA, 23 bp, Artificial Sequence
  Description of Artificial Sequence: Synthetic oligonucleotide
acggactcgcatgcgagtccgtc

SEQ ID NO: 3717 - DNA, 23 bp, Artificial Sequence
  Description of Artificial Sequence: Synthetic oligonucleotide
gaggactcgcatgcgagtcctcc

SEQ ID NO: 3718 - DNA, 23 bp, Artificial Sequence
  Description of Artificial Sequence: Synthetic oligonucleotide
gcagactcgcatgcgagtctgcc

SEQ ID NO: 3719 - DNA, 23 bp, Artificial Sequence
  Description of Artificial Sequence: Synthetic oligonucleotide
gcggactcgcatgcgagtccgca

SEQ ID NO: 3720 - DNA, 23 bp, Artificial Sequence
  Description of Artificial Sequence: Synthetic oligonucleotide
tcggactcgcatgcgagtccgac

SEQ ID NO: 3721 - DNA, 23 bp, Artificial Sequence
  Description of Artificial Sequence: Synthetic oligonucleotide
gtggactcgcatgcgagtccacc

SEQ ID NO: 3722 - DNA, 23 bp, Artificial Sequence
  Description of Artificial Sequence: Synthetic oligonucleotide
gctgactcgcatgcgagtcagcc

SEQ ID NO: 3723 - DNA, 23 bp, Artificial Sequence
  Description of Artificial Sequence: Synthetic oligonucleotide
cccgactcgcatgcgagtcgggc

SEQ ID NO: 3724 - DNA, 23 bp, Artificial Sequence
  Description of Artificial Sequence: Synthetic oligonucleotide
cccgactcgcatgcgagtcgggt

SEQ ID NO: 3725 - DNA, 23 bp, Artificial Sequence
  Description of Artificial Sequence: Synthetic oligonucleotide
accgactcgcatgcgagtcggtc

SEQ ID NO: 3726 - DNA, 23 bp, Artificial Sequence
  Description of Artificial Sequence: Synthetic oligonucleotide
cacgactcgcatgcgagtcgtgc

SEQ ID NO: 3727 - DNA, 23 bp, Artificial Sequence
  Description of Artificial Sequence: Synthetic oligonucleotide
ccagactcgcatgcgagtctggc

SEQ ID NO: 3728 - DNA, 23 bp, Artificial Sequence
  Description of Artificial Sequence: Synthetic oligonucleotide
cccgactcgcatgcgagtcggga

SEQ ID NO: 3729 - DNA, 23 bp, Artificial Sequence
  Description of Artificial Sequence: Synthetic oligonucleotide
tccgactcgcatgcgagtcggac

SEQ ID NO: 3730 - DNA, 23 bp, Artificial Sequence
  Description of Artificial Sequence: Synthetic oligonucleotide
cctgactcgcatgcgagtcaggc

SEQ ID NO: 3731 - DNA, 23 bp, Artificial Sequence
  Description of Artificial Sequence: Synthetic oligonucleotide
ggcgactcgcatgcgagtcgccc

SEQ ID NO: 3732 - DNA, 23 bp, Artificial Sequence
  Description of Artificial Sequence: Synthetic oligonucleotide
ggcgactcgcatgcgagtcgcct

SEQ ID NO: 3733 - DNA, 23 bp, Artificial Sequence
  Description of Artificial Sequence: Synthetic oligonucleotide
agcgactcgcatgcgagtcgctc

SEQ ID NO: 3734 - DNA, 23 bp, Artificial Sequence
  Description of Artificial Sequence: Synthetic oligonucleotide
gacgactcgcatgcgagtcgtcc

SEQ ID NO: 3735 - DNA, 23 bp, Artificial Sequence
  Description of Artificial Sequence: Synthetic oligonucleotide
ggagactcgcatgcgagtctccc

SEQ ID NO: 3736 - DNA, 23 bp, Artificial Sequence
  Description of Artificial Sequence: Synthetic oligonucleotide
ggcgactcgcatgcgagtcgcca

SEQ ID NO: 3737 - DNA, 23 bp, Artificial Sequence
  Description of Artificial Sequence: Synthetic oligonucleotide
tgcgactcgcatgcgagtcgcac

SEQ ID NO: 3738 - DNA, 23 bp, Artificial Sequence
  Description of Artificial Sequence: Synthetic oligonucleotide
ggtgactcgcatgcgagtcaccc

SEQ ID NO: 3739 - DNA, 23 bp, Artificial Sequence
  Description of Artificial Sequence: Synthetic oligonucleotide
cgggactcgcatgcgagtcccgt

SEQ ID NO: 3740 - DNA, 23 bp, Artificial Sequence
  Description of Artificial Sequence: Synthetic oligonucleotide
agggactcgcatgcgagtccctg

SEQ ID NO: 3741 - DNA, 23 bp, Artificial Sequence
  Description of Artificial Sequence: Synthetic oligonucleotide
caggactcgcatgcgagtcctgg

SEQ ID NO: 3742 - DNA, 23 bp, Artificial Sequence
  Description of Artificial Sequence: Synthetic oligonucleotide
cgagactcgcatgcgagtctcgg

SEQ ID NO: 3743 - DNA, 23 bp, Artificial Sequence
  Description of Artificial Sequence: Synthetic oligonucleotide
cgggactcgcatgcgagtcccga

SEQ ID NO: 3744 - DNA, 23 bp, Artificial Sequence
  Description of Artificial Sequence: Synthetic oligonucleotide
tgggactcgcatgcgagtcccag

SEQ ID NO: 3745 - DNA, 23 bp, Artificial Sequence
  Description of Artificial Sequence: Synthetic oligonucleotide
ctggactcgcatgcgagtccagg

SEQ ID NO: 3746 - DNA, 23 bp, Artificial Sequence
  Description of Artificial Sequence: Synthetic oligonucleotide
cgtgactcgcatgcgagtcacgg

SEQ ID NO: 3747 - DNA, 23 bp, Artificial Sequence
  Description of Artificial Sequence: Synthetic oligonucleotide
ggcgactcgcatgcgagtcgccg

SEQ ID NO: 3748 - DNA, 23 bp, Artificial Sequence
  Description of Artificial Sequence: Synthetic oligonucleotide
agcgactcgcatgcgagtcgctg

SEQ ID NO: 3749 - DNA, 23 bp, Artificial Sequence
  Description of Artificial Sequence: Synthetic oligonucleotide
gacgactcgcatgcgagtcgtcg

SEQ ID NO: 3750 - DNA, 23 bp, Artificial Sequence
  Description of Artificial Sequence: Synthetic oligonucleotide
ggagactcgcatgcgagtctccg

SEQ ID NO: 3751 - DNA, 23 bp, Artificial Sequence
  Description of Artificial Sequence: Synthetic oligonucleotide
tgcgactcgcatgcgagtcgcag

SEQ ID NO: 3752 - DNA, 23 bp, Artificial Sequence
  Description of Artificial Sequence: Synthetic oligonucleotide
ggtgactcgcatgcgagtcaccg

SEQ ID NO: 3753 - DNA, 23 bp, Artificial Sequence
  Description of Artificial Sequence: Synthetic oligonucleotide
acggactcgcatgcgagtccgtg

SEQ ID NO: 3754 - DNA, 23 bp, Artificial Sequence
  Description of Artificial Sequence: Synthetic oligonucleotide
ccagactcgcatgcgagtctggg

SEQ ID NO: 3755 - DNA, 23 bp, Artificial Sequence
  Description of Artificial Sequence: Synthetic oligonucleotide
tcggactcgcatgcgagtccgag

SEQ ID NO: 3756 - DNA, 23 bp, Artificial Sequence
  Description of Artificial Sequence: Synthetic oligonucleotide
cctgactcgcatgcgagtcaggg

SEQ ID NO: 3757 - DNA, 23 bp, Artificial Sequence
  Description of Artificial Sequence: Synthetic oligonucleotide
cacgactcgcatgcgagtcgtgg

SEQ ID NO: 3758 - DNA, 23 bp, Artificial Sequence
  Description of Artificial Sequence: Synthetic oligonucleotide
gccgactcgcatgcgagtcggct

SEQ ID NO: 3759 - DNA, 23 bp, Artificial Sequence
  Description of Artificial Sequence: Synthetic oligonucleotide
gccgactcgcatgcgagtcggca

SEQ ID NO: 3760 - DNA, 23 bp, Artificial Sequence
  Description of Artificial Sequence: Synthetic oligonucleotide
cgagactcgcatgcgagtctcgc

SEQ ID NO: 3761 - DNA, 23 bp, Artificial Sequence
  Description of Artificial Sequence: Synthetic oligonucleotide
cgtgactcgcatgcgagtcacgc

SEQ ID NO: 3762 - DNA, 23 bp, Artificial Sequence
  Description of Artificial Sequence: Synthetic oligonucleotide
caggactcgcatgcgagtcctgc

SEQ ID NO: 3763 - DNA, 23 bp, Artificial Sequence
  Description of Artificial Sequence: Synthetic oligonucleotide
ctggactcgcatgcgagtccagc

SEQ ID NO: 3764 - DNA, 23 bp, Artificial Sequence
  Description of Artificial Sequence: Synthetic oligonucleotide
gaggactcgcatgcgagtcctcg

SEQ ID NO: 3765 - DNA, 23 bp, Artificial Sequence
  Description of Artificial Sequence: Synthetic oligonucleotide
gtggactcgcatgcgagtccacg

SEQ ID NO: 3766 - DNA, 23 bp, Artificial Sequence
  Description of Artificial Sequence: Synthetic oligonucleotide
accgactcgcatgcgagtcggtg

SEQ ID NO: 3767 - DNA, 23 bp, Artificial Sequence
  Description of Artificial Sequence: Synthetic oligonucleotide
tccgactcgcatgcgagtcggag

SEQ ID NO: 3768 - DNA, 23 bp, Artificial Sequence
  Description of Artificial Sequence: Synthetic oligonucleotide
cgggactcgcatgcgagtcccgc

SEQ ID NO: 3769 - DNA, 23 bp, Artificial Sequence
  Description of Artificial Sequence: Synthetic oligonucleotide
agggactcgcatgcgagtccctc

SEQ ID NO: 3770 - DNA, 23 bp, Artificial Sequence
  Description of Artificial Sequence: Synthetic oligonucleotide
tgggactcgcatgcgagtcccac

SEQ ID NO: 3771 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgctagcgagtcnnnn

SEQ ID NO: 3772 - DNA, 23 bp, Artificial Sequence
  Description of Artificial Sequence: Synthetic oligonucleotide
gcggactcgctagcgagtccgcc

SEQ ID NO: 3773 - DNA, 23 bp, Artificial Sequence
  Description of Artificial Sequence: Synthetic oligonucleotide
gcggactcgctagcgagtccgct

SEQ ID NO: 3774 - DNA, 23 bp, Artificial Sequence
  Description of Artificial Sequence: Synthetic oligonucleotide
acggactcgctagcgagtccgtc

SEQ ID NO: 3775 - DNA, 23 bp, Artificial Sequence
  Description of Artificial Sequence: Synthetic oligonucleotide
gaggactcgctagcgagtcctcc

SEQ ID NO: 3776 - DNA, 23 bp, Artificial Sequence
  Description of Artificial Sequence: Synthetic oligonucleotide
gcagactcgctagcgagtctgcc

SEQ ID NO: 3777 - DNA, 23 bp, Artificial Sequence
  Description of Artificial Sequence: Synthetic oligonucleotide
gcggactcgctagcgagtccgca

SEQ ID NO: 3778 - DNA, 23 bp, Artificial Sequence
  Description of Artificial Sequence: Synthetic oligonucleotide
tcggactcgctagcgagtccgac

SEQ ID NO: 3779 - DNA, 23 bp, Artificial Sequence
  Description of Artificial Sequence: Synthetic oligonucleotide
gtggactcgctagcgagtccacc

SEQ ID NO: 3780 - DNA, 23 bp, Artificial Sequence
  Description of Artificial Sequence: Synthetic oligonucleotide
gctgactcgctagcgagtcagcc

SEQ ID NO: 3781 - DNA, 23 bp, Artificial Sequence
  Description of Artificial Sequence: Synthetic oligonucleotide
cccgactcgctagcgagtcgggc

SEQ ID NO: 3782 - DNA, 23 bp, Artificial Sequence
  Description of Artificial Sequence: Synthetic oligonucleotide
cccgactcgctagcgagtcgggt

SEQ ID NO: 3783 - DNA, 23 bp, Artificial Sequence
  Description of Artificial Sequence: Synthetic oligonucleotide
accgactcgctagcgagtcggtc

SEQ ID NO: 3784 - DNA, 23 bp, Artificial Sequence
  Description of Artificial Sequence: Synthetic oligonucleotide
cacgactcgctagcgagtcgtgc

SEQ ID NO: 3785 - DNA, 23 bp, Artificial Sequence
  Description of Artificial Sequence: Synthetic oligonucleotide
ccagactcgctagcgagtctggc

SEQ ID NO: 3786 - DNA, 23 bp, Artificial Sequence
  Description of Artificial Sequence: Synthetic oligonucleotide
cccgactcgctagcgagtcggga

SEQ ID NO: 3787 - DNA, 23 bp, Artificial Sequence
  Description of Artificial Sequence: Synthetic oligonucleotide
tccgactcgctagcgagtcggac

SEQ ID NO: 3788 - DNA, 23 bp, Artificial Sequence
  Description of Artificial Sequence: Synthetic oligonucleotide
cctgactcgctagcgagtcaggc

SEQ ID NO: 3789 - DNA, 23 bp, Artificial Sequence
  Description of Artificial Sequence: Synthetic oligonucleotide
ggcgactcgctagcgagtcgccc

SEQ ID NO: 3790 - DNA, 23 bp, Artificial Sequence
  Description of Artificial Sequence: Synthetic oligonucleotide
ggcgactcgctagcgagtcgcct

SEQ ID NO: 3791 - DNA, 23 bp, Artificial Sequence
  Description of Artificial Sequence: Synthetic oligonucleotide
agcgactcgctagcgagtcgctc

SEQ ID NO: 3792 - DNA, 23 bp, Artificial Sequence
  Description of Artificial Sequence: Synthetic oligonucleotide
gacgactcgctagcgagtcgtcc

SEQ ID NO: 3793 - DNA, 23 bp, Artificial Sequence
  Description of Artificial Sequence: Synthetic oligonucleotide
ggagactcgctagcgagtctccc

SEQ ID NO: 3794 - DNA, 23 bp, Artificial Sequence
  Description of Artificial Sequence: Synthetic oligonucleotide
ggcgactcgctagcgagtcgcca

SEQ ID NO: 3795 - DNA, 23 bp, Artificial Sequence
  Description of Artificial Sequence: Synthetic oligonucleotide
tgcgactcgctagcgagtcgcac

SEQ ID NO: 3796 - DNA, 23 bp, Artificial Sequence
  Description of Artificial Sequence: Synthetic oligonucleotide
ggtgactcgctagcgagtcaccc

SEQ ID NO: 3797 - DNA, 23 bp, Artificial Sequence
  Description of Artificial Sequence: Synthetic oligonucleotide
cgggactcgctagcgagtcccgt

SEQ ID NO: 3798 - DNA, 23 bp, Artificial Sequence
  Description of Artificial Sequence: Synthetic oligonucleotide
agggactcgctagcgagtccctg

SEQ ID NO: 3799 - DNA, 23 bp, Artificial Sequence
  Description of Artificial Sequence: Synthetic oligonucleotide
caggactcgctagcgagtcctgg

SEQ ID NO: 3800 - DNA, 23 bp, Artificial Sequence
  Description of Artificial Sequence: Synthetic oligonucleotide
cgagactcgctagcgagtctcgg

SEQ ID NO: 3801 - DNA, 23 bp, Artificial Sequence
  Description of Artificial Sequence: Synthetic oligonucleotide
cgggactcgctagcgagtcccga

SEQ ID NO: 3802 - DNA, 23 bp, Artificial Sequence
  Description of Artificial Sequence: Synthetic oligonucleotide
tgggactcgctagcgagtcccag

SEQ ID NO: 3803 - DNA, 23 bp, Artificial Sequence
  Description of Artificial Sequence: Synthetic oligonucleotide
ctggactcgctagcgagtccagg

SEQ ID NO: 3804 - DNA, 23 bp, Artificial Sequence
  Description of Artificial Sequence: Synthetic oligonucleotide
cgtgactcgctagcgagtcacgg

SEQ ID NO: 3805 - DNA, 23 bp, Artificial Sequence
  Description of Artificial Sequence: Synthetic oligonucleotide
ggcgactcgctagcgagtcgccg

SEQ ID NO: 3806 - DNA, 23 bp, Artificial Sequence
  Description of Artificial Sequence: Synthetic oligonucleotide
agcgactcgctagcgagtcgctg

SEQ ID NO: 3807 - DNA, 23 bp, Artificial Sequence
  Description of Artificial Sequence: Synthetic oligonucleotide
gacgactcgctagcgagtcgtcg

SEQ ID NO: 3808 - DNA, 23 bp, Artificial Sequence
  Description of Artificial Sequence: Synthetic oligonucleotide
ggagactcgctagcgagtctccg

SEQ ID NO: 3809 - DNA, 23 bp, Artificial Sequence
  Description of Artificial Sequence: Synthetic oligonucleotide
tgcgactcgctagcgagtcgcag

SEQ ID NO: 3810 - DNA, 23 bp, Artificial Sequence
  Description of Artificial Sequence: Synthetic oligonucleotide
ggtgactcgctagcgagtcaccg

SEQ ID NO: 3811 - DNA, 23 bp, Artificial Sequence
  Description of Artificial Sequence: Synthetic oligonucleotide
acggactcgctagcgagtccgtg

SEQ ID NO: 3812 - DNA, 23 bp, Artificial Sequence
  Description of Artificial Sequence: Synthetic oligonucleotide
ccagactcgctagcgagtctggg

SEQ ID NO: 3813 - DNA, 23 bp, Artificial Sequence
  Description of Artificial Sequence: Synthetic oligonucleotide
tcggactcgctagcgagtccgag

SEQ ID NO: 3814 - DNA, 23 bp, Artificial Sequence
  Description of Artificial Sequence: Synthetic oligonucleotide
cctgactcgctagcgagtcaggg

SEQ ID NO: 3815 - DNA, 23 bp, Artificial Sequence
  Description of Artificial Sequence: Synthetic oligonucleotide
cacgactcgctagcgagtcgtgg

SEQ ID NO: 3816 - DNA, 23 bp, Artificial Sequence
  Description of Artificial Sequence: Synthetic oligonucleotide
gccgactcgctagcgagtcggct

SEQ ID NO: 3817 - DNA, 23 bp, Artificial Sequence
  Description of Artificial Sequence: Synthetic oligonucleotide
gccgactcgctagcgagtcggca

SEQ ID NO: 3818 - DNA, 23 bp, Artificial Sequence
  Description of Artificial Sequence: Synthetic oligonucleotide
cgagactcgctagcgagtctcgc

SEQ ID NO: 3819 - DNA, 23 bp, Artificial Sequence
  Description of Artificial Sequence: Synthetic oligonucleotide
cgtgactcgctagcgagtcacgc

SEQ ID NO: 3820 - DNA, 23 bp, Artificial Sequence
  Description of Artificial Sequence: Synthetic oligonucleotide
caggactcgctagcgagtcctgc

SEQ ID NO: 3821 - DNA, 23 bp, Artificial Sequence
  Description of Artificial Sequence: Synthetic oligonucleotide
ctggactcgctagcgagtccagc

SEQ ID NO: 3822 - DNA, 23 bp, Artificial Sequence
  Description of Artificial Sequence: Synthetic oligonucleotide
gaggactcgctagcgagtcctcg

SEQ ID NO: 3823 - DNA, 23 bp, Artificial Sequence
  Description of Artificial Sequence: Synthetic oligonucleotide
gtggactcgctagcgagtccacg

SEQ ID NO: 3824 - DNA, 23 bp, Artificial Sequence
  Description of Artificial Sequence: Synthetic oligonucleotide
accgactcgctagcgagtcggtg

SEQ ID NO: 3825 - DNA, 23 bp, Artificial Sequence
  Description of Artificial Sequence: Synthetic oligonucleotide
tccgactcgctagcgagtcggag

SEQ ID NO: 3826 - DNA, 23 bp, Artificial Sequence
  Description of Artificial Sequence: Synthetic oligonucleotide
cgggactcgctagcgagtcccgc

SEQ ID NO: 3827 - DNA, 23 bp, Artificial Sequence
  Description of Artificial Sequence: Synthetic oligonucleotide
agggactcgctagcgagtccctc

SEQ ID NO: 3828 - DNA, 23 bp, Artificial Sequence
  Description of Artificial Sequence: Synthetic oligonucleotide
tgggactcgctagcgagtcccac

SEQ ID NO: 3829 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgcgcgcgagtcnnnn

SEQ ID NO: 3830 - DNA, 23 bp, Artificial Sequence
  Description of Artificial Sequence: Synthetic oligonucleotide
gcggactcgcgcgcgagtccgcc

SEQ ID NO: 3831 - DNA, 23 bp, Artificial Sequence
  Description of Artificial Sequence: Synthetic oligonucleotide
gcggactcgcgcgcgagtccgct

SEQ ID NO: 3832 - DNA, 23 bp, Artificial Sequence
  Description of Artificial Sequence: Synthetic oligonucleotide
acggactcgcgcgcgagtccgtc

SEQ ID NO: 3833 - DNA, 23 bp, Artificial Sequence
  Description of Artificial Sequence: Synthetic oligonucleotide
gaggactcgcgcgcgagtcctcc

SEQ ID NO: 3834 - DNA, 23 bp, Artificial Sequence
  Description of Artificial Sequence: Synthetic oligonucleotide
gcagactcgcgcgcgagtctgcc

SEQ ID NO: 3835 - DNA, 23 bp, Artificial Sequence
  Description of Artificial Sequence: Synthetic oligonucleotide
gcggactcgcgcgcgagtccgca

SEQ ID NO: 3836 - DNA, 23 bp, Artificial Sequence
  Description of Artificial Sequence: Synthetic oligonucleotide
tcggactcgcgcgcgagtccgac

SEQ ID NO: 3837 - DNA, 23 bp, Artificial Sequence
  Description of Artificial Sequence: Synthetic oligonucleotide
gtggactcgcgcgcgagtccacc

SEQ ID NO: 3838 - DNA, 23 bp, Artificial Sequence
  Description of Artificial Sequence: Synthetic oligonucleotide
gctgactcgcgcgcgagtcagcc

SEQ ID NO: 3839 - DNA, 23 bp, Artificial Sequence
  Description of Artificial Sequence: Synthetic oligonucleotide
cccgactcgcgcgcgagtcgggc

SEQ ID NO: 3840 - DNA, 23 bp, Artificial Sequence
  Description of Artificial Sequence: Synthetic oligonucleotide
cccgactcgcgcgcgagtcgggt

SEQ ID NO: 3841 - DNA, 23 bp, Artificial Sequence
  Description of Artificial Sequence: Synthetic oligonucleotide
accgactcgcgcgcgagtcggtc

SEQ ID NO: 3842 - DNA, 23 bp, Artificial Sequence
  Description of Artificial Sequence: Synthetic oligonucleotide
cacgactcgcgcgcgagtcgtgc

SEQ ID NO: 3843 - DNA, 23 bp, Artificial Sequence
  Description of Artificial Sequence: Synthetic oligonucleotide
ccagactcgcgcgcgagtctggc

SEQ ID NO: 3844 - DNA, 23 bp, Artificial Sequence
  Description of Artificial Sequence: Synthetic oligonucleotide
cccgactcgcgcgcgagtcggga

SEQ ID NO: 3845 - DNA, 23 bp, Artificial Sequence
  Description of Artificial Sequence: Synthetic oligonucleotide
tccgactcgcgcgcgagtcggac

SEQ ID NO: 3846 - DNA, 23 bp, Artificial Sequence
  Description of Artificial Sequence: Synthetic oligonucleotide
cctgactcgcgcgcgagtcaggc

SEQ ID NO: 3847 - DNA, 23 bp, Artificial Sequence
  Description of Artificial Sequence: Synthetic oligonucleotide
ggcgactcgcgcgcgagtcgccc

SEQ ID NO: 3848 - DNA, 23 bp, Artificial Sequence
  Description of Artificial Sequence: Synthetic oligonucleotide
ggcgactcgcgcgcgagtcgcct

SEQ ID NO: 3849 - DNA, 23 bp, Artificial Sequence
  Description of Artificial Sequence: Synthetic oligonucleotide
agcgactcgcgcgcgagtcgctc

SEQ ID NO: 3850 - DNA, 23 bp, Artificial Sequence
  Description of Artificial Sequence: Synthetic oligonucleotide
gacgactcgcgcgcgagtcgtcc

SEQ ID NO: 3851 - DNA, 23 bp, Artificial Sequence
  Description of Artificial Sequence: Synthetic oligonucleotide
ggagactcgcgcgcgagtctccc

SEQ ID NO: 3852 - DNA, 23 bp, Artificial Sequence
  Description of Artificial Sequence: Synthetic oligonucleotide
ggcgactcgcgcgcgagtcgcca

SEQ ID NO: 3853 - DNA, 23 bp, Artificial Sequence
  Description of Artificial Sequence: Synthetic oligonucleotide
tgcgactcgcgcgcgagtcgcac

SEQ ID NO: 3854 - DNA, 23 bp, Artificial Sequence
  Description of Artificial Sequence: Synthetic oligonucleotide
ggtgactcgcgcgcgagtcaccc

SEQ ID NO: 3855 - DNA, 23 bp, Artificial Sequence
  Description of Artificial Sequence: Synthetic oligonucleotide
cgggactcgcgcgcgagtcccgt

SEQ ID NO: 3856 - DNA, 23 bp, Artificial Sequence
  Description of Artificial Sequence: Synthetic oligonucleotide
agggactcgcgcgcgagtccctg

SEQ ID NO: 3857 - DNA, 23 bp, Artificial Sequence
  Description of Artificial Sequence: Synthetic oligonucleotide
caggactcgcgcgcgagtcctgg

SEQ ID NO: 3858 - DNA, 23 bp, Artificial Sequence
  Description of Artificial Sequence: Synthetic oligonucleotide
cgagactcgcgcgcgagtctcgg

SEQ ID NO: 3859 - DNA, 23 bp, Artificial Sequence
  Description of Artificial Sequence: Synthetic oligonucleotide
cgggactcgcgcgcgagtcccga

SEQ ID NO: 3860 - DNA, 23 bp, Artificial Sequence
  Description of Artificial Sequence: Synthetic oligonucleotide
tgggactcgcgcgcgagtcccag

SEQ ID NO: 3861 - DNA, 23 bp, Artificial Sequence
  Description of Artificial Sequence: Synthetic oligonucleotide
ctggactcgcgcgcgagtccagg

SEQ ID NO: 3862 - DNA, 23 bp, Artificial Sequence
  Description of Artificial Sequence: Synthetic oligonucleotide
cgtgactcgcgcgcgagtcacgg

SEQ ID NO: 3863 - DNA, 23 bp, Artificial Sequence
  Description of Artificial Sequence: Synthetic oligonucleotide
ggcgactcgcgcgcgagtcgccg

SEQ ID NO: 3864 - DNA, 23 bp, Artificial Sequence
  Description of Artificial Sequence: Synthetic oligonucleotide
agcgactcgcgcgcgagtcgctg

SEQ ID NO: 3865 - DNA, 23 bp, Artificial Sequence
  Description of Artificial Sequence: Synthetic oligonucleotide
gacgactcgcgcgcgagtcgtcg

SEQ ID NO: 3866 - DNA, 23 bp, Artificial Sequence
  Description of Artificial Sequence: Synthetic oligonucleotide
ggagactcgcgcgcgagtctccg

SEQ ID NO: 3867 - DNA, 23 bp, Artificial Sequence
  Description of Artificial Sequence: Synthetic oligonucleotide
tgcgactcgcgcgcgagtcgcag

SEQ ID NO: 3868 - DNA, 23 bp, Artificial Sequence
  Description of Artificial Sequence: Synthetic oligonucleotide
ggtgactcgcgcgcgagtcaccg

SEQ ID NO: 3869 - DNA, 23 bp, Artificial Sequence
  Description of Artificial Sequence: Synthetic oligonucleotide
acggactcgcgcgcgagtccgtg

SEQ ID NO: 3870 - DNA, 23 bp, Artificial Sequence
  Description of Artificial Sequence: Synthetic oligonucleotide
ccagactcgcgcgcgagtctggg

SEQ ID NO: 3871 - DNA, 23 bp, Artificial Sequence
  Description of Artificial Sequence: Synthetic oligonucleotide
tcggactcgcgcgcgagtccgag

SEQ ID NO: 3872 - DNA, 23 bp, Artificial Sequence
  Description of Artificial Sequence: Synthetic oligonucleotide
cctgactcgcgcgcgagtcaggg

SEQ ID NO: 3873 - DNA, 23 bp, Artificial Sequence
  Description of Artificial Sequence: Synthetic oligonucleotide
cacgactcgcgcgcgagtcgtgg

SEQ ID NO: 3874 - DNA, 23 bp, Artificial Sequence
  Description of Artificial Sequence: Synthetic oligonucleotide
gccgactcgcgcgcgagtcggct

SEQ ID NO: 3875 - DNA, 23 bp, Artificial Sequence
  Description of Artificial Sequence: Synthetic oligonucleotide
gccgactcgcgcgcgagtcggca

SEQ ID NO: 3876 - DNA, 23 bp, Artificial Sequence
  Description of Artificial Sequence: Synthetic oligonucleotide
cgagactcgcgcgcgagtctcgc

SEQ ID NO: 3877 - DNA, 23 bp, Artificial Sequence
  Description of Artificial Sequence: Synthetic oligonucleotide
cgtgactcgcgcgcgagtcacgc

SEQ ID NO: 3878 - DNA, 23 bp, Artificial Sequence
  Description of Artificial Sequence: Synthetic oligonucleotide
caggactcgcgcgcgagtcctgc

SEQ ID NO: 3879 - DNA, 23 bp, Artificial Sequence
  Description of Artificial Sequence: Synthetic oligonucleotide
ctggactcgcgcgcgagtccagc

SEQ ID NO: 3880 - DNA, 23 bp, Artificial Sequence
  Description of Artificial Sequence: Synthetic oligonucleotide
gaggactcgcgcgcgagtcctcg

SEQ ID NO: 3881 - DNA, 23 bp, Artificial Sequence
  Description of Artificial Sequence: Synthetic oligonucleotide
gtggactcgcgcgcgagtccacg

SEQ ID NO: 3882 - DNA, 23 bp, Artificial Sequence
  Description of Artificial Sequence: Synthetic oligonucleotide
accgactcgcgcgcgagtcggtg

SEQ ID NO: 3883 - DNA, 23 bp, Artificial Sequence
  Description of Artificial Sequence: Synthetic oligonucleotide
tccgactcgcgcgcgagtcggag

SEQ ID NO: 3884 - DNA, 23 bp, Artificial Sequence
  Description of Artificial Sequence: Synthetic oligonucleotide
cgggactcgcgcgcgagtcccgc

SEQ ID NO: 3885 - DNA, 23 bp, Artificial Sequence
  Description of Artificial Sequence: Synthetic oligonucleotide
agggactcgcgcgcgagtccctc

SEQ ID NO: 3886 - DNA, 23 bp, Artificial Sequence
  Description of Artificial Sequence: Synthetic oligonucleotide
tgggactcgcgcgcgagtcccac

SEQ ID NO: 3887 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgccggcgagtcnnnn

SEQ ID NO: 3888 - DNA, 23 bp, Artificial Sequence
  Description of Artificial Sequence: Synthetic oligonucleotide
gcggactcgccggcgagtccgcc

SEQ ID NO: 3889 - DNA, 23 bp, Artificial Sequence
  Description of Artificial Sequence: Synthetic oligonucleotide
gcggactcgccggcgagtccgct

SEQ ID NO: 3890 - DNA, 23 bp, Artificial Sequence
  Description of Artificial Sequence: Synthetic oligonucleotide
acggactcgccggcgagtccgtc

SEQ ID NO: 3891 - DNA, 23 bp, Artificial Sequence
  Description of Artificial Sequence: Synthetic oligonucleotide
gaggactcgccggcgagtcctcc

SEQ ID NO: 3892 - DNA, 23 bp, Artificial Sequence
  Description of Artificial Sequence: Synthetic oligonucleotide
gcagactcgccggcgagtctgcc

SEQ ID NO: 3893 - DNA, 23 bp, Artificial Sequence
  Description of Artificial Sequence: Synthetic oligonucleotide
gcggactcgccggcgagtccgca

SEQ ID NO: 3894 - DNA, 23 bp, Artificial Sequence
  Description of Artificial Sequence: Synthetic oligonucleotide
tcggactcgccggcgagtccgac

SEQ ID NO: 3895 - DNA, 23 bp, Artificial Sequence
  Description of Artificial Sequence: Synthetic oligonucleotide
gtggactcgccggcgagtccacc

SEQ ID NO: 3896 - DNA, 23 bp, Artificial Sequence
  Description of Artificial Sequence: Synthetic oligonucleotide
gctgactcgccggcgagtcagcc

SEQ ID NO: 3897 - DNA, 23 bp, Artificial Sequence
  Description of Artificial Sequence: Synthetic oligonucleotide
cccgactcgccggcgagtcgggc

SEQ ID NO: 3898 - DNA, 23 bp, Artificial Sequence
  Description of Artificial Sequence: Synthetic oligonucleotide
cccgactcgccggcgagtcgggt

SEQ ID NO: 3899 - DNA, 23 bp, Artificial Sequence
  Description of Artificial Sequence: Synthetic oligonucleotide
accgactcgccggcgagtcggtc

SEQ ID NO: 3900 - DNA, 23 bp, Artificial Sequence
  Description of Artificial Sequence: Synthetic oligonucleotide
cacgactcgccggcgagtcgtgc

SEQ ID NO: 3901 - DNA, 23 bp, Artificial Sequence
  Description of Artificial Sequence: Synthetic oligonucleotide
ccagactcgccggcgagtctggc

SEQ ID NO: 3902 - DNA, 23 bp, Artificial Sequence
  Description of Artificial Sequence: Synthetic oligonucleotide
cccgactcgccggcgagtcggga

SEQ ID NO: 3903 - DNA, 23 bp, Artificial Sequence
  Description of Artificial Sequence: Synthetic oligonucleotide
tccgactcgccggcgagtcggac

SEQ ID NO: 3904 - DNA, 23 bp, Artificial Sequence
  Description of Artificial Sequence: Synthetic oligonucleotide
cctgactcgccggcgagtcaggc

SEQ ID NO: 3905 - DNA, 23 bp, Artificial Sequence
  Description of Artificial Sequence: Synthetic oligonucleotide
ggcgactcgccggcgagtcgccc

SEQ ID NO: 3906 - DNA, 23 bp, Artificial Sequence
  Description of Artificial Sequence: Synthetic oligonucleotide
ggcgactcgccggcgagtcgcct

SEQ ID NO: 3907 - DNA, 23 bp, Artificial Sequence
  Description of Artificial Sequence: Synthetic oligonucleotide
agcgactcgccggcgagtcgctc

SEQ ID NO: 3908 - DNA, 23 bp, Artificial Sequence
  Description of Artificial Sequence: Synthetic oligonucleotide
gacgactcgccggcgagtcgtcc

SEQ ID NO: 3909 - DNA, 23 bp, Artificial Sequence
  Description of Artificial Sequence: Synthetic oligonucleotide
ggagactcgccggcgagtctccc

SEQ ID NO: 3910 - DNA, 23 bp, Artificial Sequence
  Description of Artificial Sequence: Synthetic oligonucleotide
ggcgactcgccggcgagtcgcca

SEQ ID NO: 3911 - DNA, 23 bp, Artificial Sequence
  Description of Artificial Sequence: Synthetic oligonucleotide
tgcgactcgccggcgagtcgcac

SEQ ID NO: 3912 - DNA, 23 bp, Artificial Sequence
  Description of Artificial Sequence: Synthetic oligonucleotide
ggtgactcgccggcgagtcaccc

SEQ ID NO: 3913 - DNA, 23 bp, Artificial Sequence
  Description of Artificial Sequence: Synthetic oligonucleotide
cgggactcgccggcgagtcccgt

SEQ ID NO: 3914 - DNA, 23 bp, Artificial Sequence
  Description of Artificial Sequence: Synthetic oligonucleotide
agggactcgccggcgagtccctg

SEQ ID NO: 3915 - DNA, 23 bp, Artificial Sequence
  Description of Artificial Sequence: Synthetic oligonucleotide
caggactcgccggcgagtcctgg

SEQ ID NO: 3916 - DNA, 23 bp, Artificial Sequence
  Description of Artificial Sequence: Synthetic oligonucleotide
cgagactcgccggcgagtctcgg

SEQ ID NO: 3917 - DNA, 23 bp, Artificial Sequence
  Description of Artificial Sequence: Synthetic oligonucleotide
cgggactcgccggcgagtcccga

SEQ ID NO: 3918 - DNA, 23 bp, Artificial Sequence
  Description of Artificial Sequence: Synthetic oligonucleotide
tgggactcgccggcgagtcccag

SEQ ID NO: 3919 - DNA, 23 bp, Artificial Sequence
  Description of Artificial Sequence: Synthetic oligonucleotide
ctggactcgccggcgagtccagg

SEQ ID NO: 3920 - DNA, 23 bp, Artificial Sequence
  Description of Artificial Sequence: Synthetic oligonucleotide
cgtgactcgccggcgagtcacgg

SEQ ID NO: 3921 - DNA, 23 bp, Artificial Sequence
  Description of Artificial Sequence: Synthetic oligonucleotide
ggcgactcgccggcgagtcgccg

SEQ ID NO: 3922 - DNA, 23 bp, Artificial Sequence
  Description of Artificial Sequence: Synthetic oligonucleotide
agcgactcgccggcgagtcgctg

SEQ ID NO: 3923 - DNA, 23 bp, Artificial Sequence
  Description of Artificial Sequence: Synthetic oligonucleotide
gacgactcgccggcgagtcgtcg

SEQ ID NO: 3924 - DNA, 23 bp, Artificial Sequence
  Description of Artificial Sequence: Synthetic oligonucleotide
ggagactcgccggcgagtctccg

SEQ ID NO: 3925 - DNA, 23 bp, Artificial Sequence
  Description of Artificial Sequence: Synthetic oligonucleotide
tgcgactcgccggcgagtcgcag

SEQ ID NO: 3926 - DNA, 23 bp, Artificial Sequence
  Description of Artificial Sequence: Synthetic oligonucleotide
ggtgactcgccggcgagtcaccg

SEQ ID NO: 3927 - DNA, 23 bp, Artificial Sequence
  Description of Artificial Sequence: Synthetic oligonucleotide
acggactcgccggcgagtccgtg

SEQ ID NO: 3928 - DNA, 23 bp, Artificial Sequence
  Description of Artificial Sequence: Synthetic oligonucleotide
ccagactcgccggcgagtctggg

SEQ ID NO: 3929 - DNA, 23 bp, Artificial Sequence
  Description of Artificial Sequence: Synthetic oligonucleotide
tcggactcgccggcgagtccgag

SEQ ID NO: 3930 - DNA, 23 bp, Artificial Sequence
  Description of Artificial Sequence: Synthetic oligonucleotide
cctgactcgccggcgagtcaggg

SEQ ID NO: 3931 - DNA, 23 bp, Artificial Sequence
  Description of Artificial Sequence: Synthetic oligonucleotide
cacgactcgccggcgagtcgtgg

SEQ ID NO: 3932 - DNA, 23 bp, Artificial Sequence
  Description of Artificial Sequence: Synthetic oligonucleotide
gccgactcgccggcgagtcggct

SEQ ID NO: 3933 - DNA, 23 bp, Artificial Sequence
  Description of Artificial Sequence: Synthetic oligonucleotide
gccgactcgccggcgagtcggca

SEQ ID NO: 3934 - DNA, 23 bp, Artificial Sequence
  Description of Artificial Sequence: Synthetic oligonucleotide
cgagactcgccggcgagtctcgc

SEQ ID NO: 3935 - DNA, 23 bp, Artificial Sequence
  Description of Artificial Sequence: Synthetic oligonucleotide
cgtgactcgccggcgagtcacgc

SEQ ID NO: 3936 - DNA, 23 bp, Artificial Sequence
  Description of Artificial Sequence: Synthetic oligonucleotide
caggactcgccggcgagtcctgc

SEQ ID NO: 3937 - DNA, 23 bp, Artificial Sequence
  Description of Artificial Sequence: Synthetic oligonucleotide
ctggactcgccggcgagtccagc

SEQ ID NO: 3938 - DNA, 23 bp, Artificial Sequence
  Description of Artificial Sequence: Synthetic oligonucleotide
gaggactcgccggcgagtcctcg

SEQ ID NO: 3939 - DNA, 23 bp, Artificial Sequence
  Description of Artificial Sequence: Synthetic oligonucleotide
gtggactcgccggcgagtccacg

SEQ ID NO: 3940 - DNA, 23 bp, Artificial Sequence
  Description of Artificial Sequence: Synthetic oligonucleotide
accgactcgccggcgagtcggtg

SEQ ID NO: 3941 - DNA, 23 bp, Artificial Sequence
  Description of Artificial Sequence: Synthetic oligonucleotide
tccgactcgccggcgagtcggag

SEQ ID NO: 3942 - DNA, 23 bp, Artificial Sequence
  Description of Artificial Sequence: Synthetic oligonucleotide
cgggactcgccggcgagtcccgc

SEQ ID NO: 3943 - DNA, 23 bp, Artificial Sequence
  Description of Artificial Sequence: Synthetic oligonucleotide
agggactcgccggcgagtccctc

SEQ ID NO: 3944 - DNA, 23 bp, Artificial Sequence
  Description of Artificial Sequence: Synthetic oligonucleotide
tgggactcgccggcgagtcccac

SEQ ID NO: 3945 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcacatgtgagtcnnnn

SEQ ID NO: 3946 - DNA, 23 bp, Artificial Sequence
  Description of Artificial Sequence: Synthetic oligonucleotide
gcggactcacatgtgagtccgcc

SEQ ID NO: 3947 - DNA, 23 bp, Artificial Sequence
  Description of Artificial Sequence: Synthetic oligonucleotide
gcggactcacatgtgagtccgct

SEQ ID NO: 3948 - DNA, 23 bp, Artificial Sequence
  Description of Artificial Sequence: Synthetic oligonucleotide
acggactcacatgtgagtccgtc

SEQ ID NO: 3949 - DNA, 23 bp, Artificial Sequence
  Description of Artificial Sequence: Synthetic oligonucleotide
gaggactcacatgtgagtcctcc

SEQ ID NO: 3950 - DNA, 23 bp, Artificial Sequence
  Description of Artificial Sequence: Synthetic oligonucleotide
gcagactcacatgtgagtctgcc

SEQ ID NO: 3951 - DNA, 23 bp, Artificial Sequence
  Description of Artificial Sequence: Synthetic oligonucleotide
gcggactcacatgtgagtccgca

SEQ ID NO: 3952 - DNA, 23 bp, Artificial Sequence
  Description of Artificial Sequence: Synthetic oligonucleotide
tcggactcacatgtgagtccgac

SEQ ID NO: 3953 - DNA, 23 bp, Artificial Sequence
  Description of Artificial Sequence: Synthetic oligonucleotide
gtggactcacatgtgagtccacc

SEQ ID NO: 3954 - DNA, 23 bp, Artificial Sequence
  Description of Artificial Sequence: Synthetic oligonucleotide
gctgactcacatgtgagtcagcc

SEQ ID NO: 3955 - DNA, 23 bp, Artificial Sequence
  Description of Artificial Sequence: Synthetic oligonucleotide
cccgactcacatgtgagtcgggc

SEQ ID NO: 3956 - DNA, 23 bp, Artificial Sequence
  Description of Artificial Sequence: Synthetic oligonucleotide
cccgactcacatgtgagtcgggt

SEQ ID NO: 3957 - DNA, 23 bp, Artificial Sequence
  Description of Artificial Sequence: Synthetic oligonucleotide
accgactcacatgtgagtcggtc

SEQ ID NO: 3958 - DNA, 23 bp, Artificial Sequence
  Description of Artificial Sequence: Synthetic oligonucleotide
cacgactcacatgtgagtcgtgc

SEQ ID NO: 3959 - DNA, 23 bp, Artificial Sequence
  Description of Artificial Sequence: Synthetic oligonucleotide
ccagactcacatgtgagtctggc

SEQ ID NO: 3960 - DNA, 23 bp, Artificial Sequence
  Description of Artificial Sequence: Synthetic oligonucleotide
cccgactcacatgtgagtcggga

SEQ ID NO: 3961 - DNA, 23 bp, Artificial Sequence
  Description of Artificial Sequence: Synthetic oligonucleotide
tccgactcacatgtgagtcggac

SEQ ID NO: 3962 - DNA, 23 bp, Artificial Sequence
  Description of Artificial Sequence: Synthetic oligonucleotide
cctgactcacatgtgagtcaggc

SEQ ID NO: 3963 - DNA, 23 bp, Artificial Sequence
  Description of Artificial Sequence: Synthetic oligonucleotide
ggcgactcacatgtgagtcgccc

SEQ ID NO: 3964 - DNA, 23 bp, Artificial Sequence
  Description of Artificial Sequence: Synthetic oligonucleotide
ggcgactcacatgtgagtcgcct

SEQ ID NO: 3965 - DNA, 23 bp, Artificial Sequence
  Description of Artificial Sequence: Synthetic oligonucleotide
agcgactcacatgtgagtcgctc

SEQ ID NO: 3966 - DNA, 23 bp, Artificial Sequence
  Description of Artificial Sequence: Synthetic oligonucleotide
gacgactcacatgtgagtcgtcc

SEQ ID NO: 3967 - DNA, 23 bp, Artificial Sequence
  Description of Artificial Sequence: Synthetic oligonucleotide
ggagactcacatgtgagtctccc

SEQ ID NO: 3968 - DNA, 23 bp, Artificial Sequence
  Description of Artificial Sequence: Synthetic oligonucleotide
ggcgactcacatgtgagtcgcca

SEQ ID NO: 3969 - DNA, 23 bp, Artificial Sequence
  Description of Artificial Sequence: Synthetic oligonucleotide
tgcgactcacatgtgagtcgcac

SEQ ID NO: 3970 - DNA, 23 bp, Artificial Sequence
  Description of Artificial Sequence: Synthetic oligonucleotide
ggtgactcacatgtgagtcaccc

SEQ ID NO: 3971 - DNA, 23 bp, Artificial Sequence
  Description of Artificial Sequence: Synthetic oligonucleotide
cgggactcacatgtgagtcccgt

SEQ ID NO: 3972 - DNA, 23 bp, Artificial Sequence
  Description of Artificial Sequence: Synthetic oligonucleotide
agggactcacatgtgagtccctg

SEQ ID NO: 3973 - DNA, 23 bp, Artificial Sequence
  Description of Artificial Sequence: Synthetic oligonucleotide
caggactcacatgtgagtcctgg

SEQ ID NO: 3974 - DNA, 23 bp, Artificial Sequence
  Description of Artificial Sequence: Synthetic oligonucleotide
cgagactcacatgtgagtctcgg

SEQ ID NO: 3975 - DNA, 23 bp, Artificial Sequence
  Description of Artificial Sequence: Synthetic oligonucleotide
cgggactcacatgtgagtcccga

SEQ ID NO: 3976 - DNA, 23 bp, Artificial Sequence
  Description of Artificial Sequence: Synthetic oligonucleotide
tgggactcacatgtgagtcccag

SEQ ID NO: 3977 - DNA, 23 bp, Artificial Sequence
  Description of Artificial Sequence: Synthetic oligonucleotide
ctggactcacatgtgagtccagg

SEQ ID NO: 3978 - DNA, 23 bp, Artificial Sequence
  Description of Artificial Sequence: Synthetic oligonucleotide
cgtgactcacatgtgagtcacgg

SEQ ID NO: 3979 - DNA, 23 bp, Artificial Sequence
  Description of Artificial Sequence: Synthetic oligonucleotide
ggcgactcacatgtgagtcgccg

SEQ ID NO: 3980 - DNA, 23 bp, Artificial Sequence
  Description of Artificial Sequence: Synthetic oligonucleotide
agcgactcacatgtgagtcgctg

SEQ ID NO: 3981 - DNA, 23 bp, Artificial Sequence
  Description of Artificial Sequence: Synthetic oligonucleotide
gacgactcacatgtgagtcgtcg

SEQ ID NO: 3982 - DNA, 23 bp, Artificial Sequence
  Description of Artificial Sequence: Synthetic oligonucleotide
ggagactcacatgtgagtctccg

SEQ ID NO: 3983 - DNA, 23 bp, Artificial Sequence
  Description of Artificial Sequence: Synthetic oligonucleotide
tgcgactcacatgtgagtcgcag

SEQ ID NO: 3984 - DNA, 23 bp, Artificial Sequence
  Description of Artificial Sequence: Synthetic oligonucleotide
ggtgactcacatgtgagtcaccg

SEQ ID NO: 3985 - DNA, 23 bp, Artificial Sequence
  Description of Artificial Sequence: Synthetic oligonucleotide
acggactcacatgtgagtccgtg

SEQ ID NO: 3986 - DNA, 23 bp, Artificial Sequence
  Description of Artificial Sequence: Synthetic oligonucleotide
ccagactcacatgtgagtctggg

SEQ ID NO: 3987 - DNA, 23 bp, Artificial Sequence
  Description of Artificial Sequence: Synthetic oligonucleotide
tcggactcacatgtgagtccgag

SEQ ID NO: 3988 - DNA, 23 bp, Artificial Sequence
  Description of Artificial Sequence: Synthetic oligonucleotide
cctgactcacatgtgagtcaggg

SEQ ID NO: 3989 - DNA, 23 bp, Artificial Sequence
  Description of Artificial Sequence: Synthetic oligonucleotide
cacgactcacatgtgagtcgtgg

SEQ ID NO: 3990 - DNA, 23 bp, Artificial Sequence
  Description of Artificial Sequence: Synthetic oligonucleotide
gccgactcacatgtgagtcggct

SEQ ID NO: 3991 - DNA, 23 bp, Artificial Sequence
  Description of Artificial Sequence: Synthetic oligonucleotide
gccgactcacatgtgagtcggca

SEQ ID NO: 3992 - DNA, 23 bp, Artificial Sequence
  Description of Artificial Sequence: Synthetic oligonucleotide
cgagactcacatgtgagtctcgc

SEQ ID NO: 3993 - DNA, 23 bp, Artificial Sequence
  Description of Artificial Sequence: Synthetic oligonucleotide
cgtgactcacatgtgagtcacgc

SEQ ID NO: 3994 - DNA, 23 bp, Artificial Sequence
  Description of Artificial Sequence: Synthetic oligonucleotide
caggactcacatgtgagtcctgc

SEQ ID NO: 3995 - DNA, 23 bp, Artificial Sequence
  Description of Artificial Sequence: Synthetic oligonucleotide
ctggactcacatgtgagtccagc

SEQ ID NO: 3996 - DNA, 23 bp, Artificial Sequence
  Description of Artificial Sequence: Synthetic oligonucleotide
gaggactcacatgtgagtcctcg

SEQ ID NO: 3997 - DNA, 23 bp, Artificial Sequence
  Description of Artificial Sequence: Synthetic oligonucleotide
gtggactcacatgtgagtccacg

SEQ ID NO: 3998 - DNA, 23 bp, Artificial Sequence
  Description of Artificial Sequence: Synthetic oligonucleotide
accgactcacatgtgagtcggtg

SEQ ID NO: 3999 - DNA, 23 bp, Artificial Sequence
  Description of Artificial Sequence: Synthetic oligonucleotide
tccgactcacatgtgagtcggag

SEQ ID NO: 4000 - DNA, 23 bp, Artificial Sequence
  Description of Artificial Sequence: Synthetic oligonucleotide
cgggactcacatgtgagtcccgc

SEQ ID NO: 4001 - DNA, 23 bp, Artificial Sequence
  Description of Artificial Sequence: Synthetic oligonucleotide
agggactcacatgtgagtccctc

SEQ ID NO: 4002 - DNA, 23 bp, Artificial Sequence
  Description of Artificial Sequence: Synthetic oligonucleotide
tgggactcacatgtgagtcccac

SEQ ID NO: 4003 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcactagtgagtcnnnn

SEQ ID NO: 4004 - DNA, 23 bp, Artificial Sequence
  Description of Artificial Sequence: Synthetic oligonucleotide
gcggactcactagtgagtccgcc

SEQ ID NO: 4005 - DNA, 23 bp, Artificial Sequence
  Description of Artificial Sequence: Synthetic oligonucleotide
gcggactcactagtgagtccgct

SEQ ID NO: 4006 - DNA, 23 bp, Artificial Sequence
  Description of Artificial Sequence: Synthetic oligonucleotide
acggactcactagtgagtccgtc

SEQ ID NO: 4007 - DNA, 23 bp, Artificial Sequence
  Description of Artificial Sequence: Synthetic oligonucleotide
gaggactcactagtgagtcctcc

SEQ ID NO: 4008 - DNA, 23 bp, Artificial Sequence
  Description of Artificial Sequence: Synthetic oligonucleotide
gcagactcactagtgagtctgcc

SEQ ID NO: 4009 - DNA, 23 bp, Artificial Sequence
  Description of Artificial Sequence: Synthetic oligonucleotide
gcggactcactagtgagtccgca

SEQ ID NO: 4010 - DNA, 23 bp, Artificial Sequence
  Description of Artificial Sequence: Synthetic oligonucleotide
tcggactcactagtgagtccgac

SEQ ID NO: 4011 - DNA, 23 bp, Artificial Sequence
  Description of Artificial Sequence: Synthetic oligonucleotide
gtggactcactagtgagtccacc

SEQ ID NO: 4012 - DNA, 23 bp, Artificial Sequence
  Description of Artificial Sequence: Synthetic oligonucleotide
gctgactcactagtgagtcagcc

SEQ ID NO: 4013 - DNA, 23 bp, Artificial Sequence
  Description of Artificial Sequence: Synthetic oligonucleotide
cccgactcactagtgagtcgggc

SEQ ID NO: 4014 - DNA, 23 bp, Artificial Sequence
  Description of Artificial Sequence: Synthetic oligonucleotide
cccgactcactagtgagtcgggt

SEQ ID NO: 4015 - DNA, 23 bp, Artificial Sequence
  Description of Artificial Sequence: Synthetic oligonucleotide
accgactcactagtgagtcggtc

SEQ ID NO: 4016 - DNA, 23 bp, Artificial Sequence
  Description of Artificial Sequence: Synthetic oligonucleotide
cacgactcactagtgagtcgtgc

SEQ ID NO: 4017 - DNA, 23 bp, Artificial Sequence
  Description of Artificial Sequence: Synthetic oligonucleotide
ccagactcactagtgagtctggc

SEQ ID NO: 4018 - DNA, 23 bp, Artificial Sequence
  Description of Artificial Sequence: Synthetic oligonucleotide
cccgactcactagtgagtcggga

SEQ ID NO: 4019 - DNA, 23 bp, Artificial Sequence
  Description of Artificial Sequence: Synthetic oligonucleotide
tccgactcactagtgagtcggac

SEQ ID NO: 4020 - DNA, 23 bp, Artificial Sequence
  Description of Artificial Sequence: Synthetic oligonucleotide
cctgactcactagtgagtcaggc

SEQ ID NO: 4021 - DNA, 23 bp, Artificial Sequence
  Description of Artificial Sequence: Synthetic oligonucleotide
ggcgactcactagtgagtcgccc

SEQ ID NO: 4022 - DNA, 23 bp, Artificial Sequence
  Description of Artificial Sequence: Synthetic oligonucleotide
ggcgactcactagtgagtcgcct

SEQ ID NO: 4023 - DNA, 23 bp, Artificial Sequence
  Description of Artificial Sequence: Synthetic oligonucleotide
agcgactcactagtgagtcgctc

SEQ ID NO: 4024 - DNA, 23 bp, Artificial Sequence
  Description of Artificial Sequence: Synthetic oligonucleotide
gacgactcactagtgagtcgtcc

SEQ ID NO: 4025 - DNA, 23 bp, Artificial Sequence
  Description of Artificial Sequence: Synthetic oligonucleotide
ggagactcactagtgagtctccc

SEQ ID NO: 4026 - DNA, 23 bp, Artificial Sequence
  Description of Artificial Sequence: Synthetic oligonucleotide
ggcgactcactagtgagtcgcca

SEQ ID NO: 4027 - DNA, 23 bp, Artificial Sequence
  Description of Artificial Sequence: Synthetic oligonucleotide
tgcgactcactagtgagtcgcac

SEQ ID NO: 4028 - DNA, 23 bp, Artificial Sequence
  Description of Artificial Sequence: Synthetic oligonucleotide
ggtgactcactagtgagtcaccc

SEQ ID NO: 4029 - DNA, 23 bp, Artificial Sequence
  Description of Artificial Sequence: Synthetic oligonucleotide
cgggactcactagtgagtcccgt

SEQ ID NO: 4030 - DNA, 23 bp, Artificial Sequence
  Description of Artificial Sequence: Synthetic oligonucleotide
agggactcactagtgagtccctg

SEQ ID NO: 4031 - DNA, 23 bp, Artificial Sequence
  Description of Artificial Sequence: Synthetic oligonucleotide
caggactcactagtgagtcctgg

SEQ ID NO: 4032 - DNA, 23 bp, Artificial Sequence
  Description of Artificial Sequence: Synthetic oligonucleotide
cgagactcactagtgagtctcgg

SEQ ID NO: 4033 - DNA, 23 bp, Artificial Sequence
  Description of Artificial Sequence: Synthetic oligonucleotide
cgggactcactagtgagtcccga

SEQ ID NO: 4034 - DNA, 23 bp, Artificial Sequence
  Description of Artificial Sequence: Synthetic oligonucleotide
tgggactcactagtgagtcccag

SEQ ID NO: 4035 - DNA, 23 bp, Artificial Sequence
  Description of Artificial Sequence: Synthetic oligonucleotide
ctggactcactagtgagtccagg

SEQ ID NO: 4036 - DNA, 23 bp, Artificial Sequence
  Description of Artificial Sequence: Synthetic oligonucleotide
cgtgactcactagtgagtcacgg

SEQ ID NO: 4037 - DNA, 23 bp, Artificial Sequence
  Description of Artificial Sequence: Synthetic oligonucleotide
ggcgactcactagtgagtcgccg

SEQ ID NO: 4038 - DNA, 23 bp, Artificial Sequence
  Description of Artificial Sequence: Synthetic oligonucleotide
agcgactcactagtgagtcgctg

SEQ ID NO: 4039 - DNA, 23 bp, Artificial Sequence
  Description of Artificial Sequence: Synthetic oligonucleotide
gacgactcactagtgagtcgtcg

SEQ ID NO: 4040 - DNA, 23 bp, Artificial Sequence
  Description of Artificial Sequence: Synthetic oligonucleotide
ggagactcactagtgagtctccg

SEQ ID NO: 4041 - DNA, 23 bp, Artificial Sequence
  Description of Artificial Sequence: Synthetic oligonucleotide
tgcgactcactagtgagtcgcag

SEQ ID NO: 4042 - DNA, 23 bp, Artificial Sequence
  Description of Artificial Sequence: Synthetic oligonucleotide
ggtgactcactagtgagtcaccg

SEQ ID NO: 4043 - DNA, 23 bp, Artificial Sequence
  Description of Artificial Sequence: Synthetic oligonucleotide
acggactcactagtgagtccgtg

SEQ ID NO: 4044 - DNA, 23 bp, Artificial Sequence
  Description of Artificial Sequence: Synthetic oligonucleotide
ccagactcactagtgagtctggg

SEQ ID NO: 4045 - DNA, 23 bp, Artificial Sequence
  Description of Artificial Sequence: Synthetic oligonucleotide
tcggactcactagtgagtccgag

SEQ ID NO: 4046 - DNA, 23 bp, Artificial Sequence
  Description of Artificial Sequence: Synthetic oligonucleotide
cctgactcactagtgagtcaggg

SEQ ID NO: 4047 - DNA, 23 bp, Artificial Sequence
  Description of Artificial Sequence: Synthetic oligonucleotide
cacgactcactagtgagtcgtgg

SEQ ID NO: 4048 - DNA, 23 bp, Artificial Sequence
  Description of Artificial Sequence: Synthetic oligonucleotide
gccgactcactagtgagtcggct

SEQ ID NO: 4049 - DNA, 23 bp, Artificial Sequence
  Description of Artificial Sequence: Synthetic oligonucleotide
gccgactcactagtgagtcggca

SEQ ID NO: 4050 - DNA, 23 bp, Artificial Sequence
  Description of Artificial Sequence: Synthetic oligonucleotide
cgagactcactagtgagtctcgc

SEQ ID NO: 4051 - DNA, 23 bp, Artificial Sequence
  Description of Artificial Sequence: Synthetic oligonucleotide
cgtgactcactagtgagtcacgc

SEQ ID NO: 4052 - DNA, 23 bp, Artificial Sequence
  Description of Artificial Sequence: Synthetic oligonucleotide
caggactcactagtgagtcctgc

SEQ ID NO: 4053 - DNA, 23 bp, Artificial Sequence
  Description of Artificial Sequence: Synthetic oligonucleotide
ctggactcactagtgagtccagc

SEQ ID NO: 4054 - DNA, 23 bp, Artificial Sequence
  Description of Artificial Sequence: Synthetic oligonucleotide
gaggactcactagtgagtcctcg

SEQ ID NO: 4055 - DNA, 23 bp, Artificial Sequence
  Description of Artificial Sequence: Synthetic oligonucleotide
gtggactcactagtgagtccacg

SEQ ID NO: 4056 - DNA, 23 bp, Artificial Sequence
  Description of Artificial Sequence: Synthetic oligonucleotide
accgactcactagtgagtcggtg

SEQ ID NO: 4057 - DNA, 23 bp, Artificial Sequence
  Description of Artificial Sequence: Synthetic oligonucleotide
tccgactcactagtgagtcggag

SEQ ID NO: 4058 - DNA, 23 bp, Artificial Sequence
  Description of Artificial Sequence: Synthetic oligonucleotide
cgggactcactagtgagtcccgc

SEQ ID NO: 4059 - DNA, 23 bp, Artificial Sequence
  Description of Artificial Sequence: Synthetic oligonucleotide
agggactcactagtgagtccctc

SEQ ID NO: 4060 - DNA, 23 bp, Artificial Sequence
  Description of Artificial Sequence: Synthetic oligonucleotide
tgggactcactagtgagtcccac

SEQ ID NO: 4061 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcacgcgtgagtcnnnn

SEQ ID NO: 4062 - DNA, 23 bp, Artificial Sequence
  Description of Artificial Sequence: Synthetic oligonucleotide
gcggactcacgcgtgagtccgcc

SEQ ID NO: 4063 - DNA, 23 bp, Artificial Sequence
  Description of Artificial Sequence: Synthetic oligonucleotide
gcggactcacgcgtgagtccgct

SEQ ID NO: 4064 - DNA, 23 bp, Artificial Sequence
  Description of Artificial Sequence: Synthetic oligonucleotide
acggactcacgcgtgagtccgtc

SEQ ID NO: 4065 - DNA, 23 bp, Artificial Sequence
  Description of Artificial Sequence: Synthetic oligonucleotide
gaggactcacgcgtgagtcctcc

SEQ ID NO: 4066 - DNA, 23 bp, Artificial Sequence
  Description of Artificial Sequence: Synthetic oligonucleotide
gcagactcacgcgtgagtctgcc

SEQ ID NO: 4067 - DNA, 23 bp, Artificial Sequence
  Description of Artificial Sequence: Synthetic oligonucleotide
gcggactcacgcgtgagtccgca

SEQ ID NO: 4068 - DNA, 23 bp, Artificial Sequence
  Description of Artificial Sequence: Synthetic oligonucleotide
tcggactcacgcgtgagtccgac

SEQ ID NO: 4069 - DNA, 23 bp, Artificial Sequence
  Description of Artificial Sequence: Synthetic oligonucleotide
gtggactcacgcgtgagtccacc

SEQ ID NO: 4070 - DNA, 23 bp, Artificial Sequence
  Description of Artificial Sequence: Synthetic oligonucleotide
gctgactcacgcgtgagtcagcc

SEQ ID NO: 4071 - DNA, 23 bp, Artificial Sequence
  Description of Artificial Sequence: Synthetic oligonucleotide
cccgactcacgcgtgagtcgggc

SEQ ID NO: 4072 - DNA, 23 bp, Artificial Sequence
  Description of Artificial Sequence: Synthetic oligonucleotide
cccgactcacgcgtgagtcgggt

SEQ ID NO: 4073 - DNA, 23 bp, Artificial Sequence
  Description of Artificial Sequence: Synthetic oligonucleotide
accgactcacgcgtgagtcggtc

SEQ ID NO: 4074 - DNA, 23 bp, Artificial Sequence
  Description of Artificial Sequence: Synthetic oligonucleotide
cacgactcacgcgtgagtcgtgc

SEQ ID NO: 4075 - DNA, 23 bp, Artificial Sequence
  Description of Artificial Sequence: Synthetic oligonucleotide
ccagactcacgcgtgagtctggc

SEQ ID NO: 4076 - DNA, 23 bp, Artificial Sequence
  Description of Artificial Sequence: Synthetic oligonucleotide
cccgactcacgcgtgagtcggga

SEQ ID NO: 4077 - DNA, 23 bp, Artificial Sequence
  Description of Artificial Sequence: Synthetic oligonucleotide
tccgactcacgcgtgagtcggac

SEQ ID NO: 4078 - DNA, 23 bp, Artificial Sequence
  Description of Artificial Sequence: Synthetic oligonucleotide
cctgactcacgcgtgagtcaggc

SEQ ID NO: 4079 - DNA, 23 bp, Artificial Sequence
  Description of Artificial Sequence: Synthetic oligonucleotide
ggcgactcacgcgtgagtcgccc

SEQ ID NO: 4080 - DNA, 23 bp, Artificial Sequence
  Description of Artificial Sequence: Synthetic oligonucleotide
ggcgactcacgcgtgagtcgcct

SEQ ID NO: 4081 - DNA, 23 bp, Artificial Sequence
  Description of Artificial Sequence: Synthetic oligonucleotide
agcgactcacgcgtgagtcgctc

SEQ ID NO: 4082 - DNA, 23 bp, Artificial Sequence
  Description of Artificial Sequence: Synthetic oligonucleotide
gacgactcacgcgtgagtcgtcc

SEQ ID NO: 4083 - DNA, 23 bp, Artificial Sequence
  Description of Artificial Sequence: Synthetic oligonucleotide
ggagactcacgcgtgagtctccc

SEQ ID NO: 4084 - DNA, 23 bp, Artificial Sequence
  Description of Artificial Sequence: Synthetic oligonucleotide
ggcgactcacgcgtgagtcgcca

SEQ ID NO: 4085 - DNA, 23 bp, Artificial Sequence
  Description of Artificial Sequence: Synthetic oligonucleotide
tgcgactcacgcgtgagtcgcac

SEQ ID NO: 4086 - DNA, 23 bp, Artificial Sequence
  Description of Artificial Sequence: Synthetic oligonucleotide
ggtgactcacgcgtgagtcaccc

SEQ ID NO: 4087 - DNA, 23 bp, Artificial Sequence
  Description of Artificial Sequence: Synthetic oligonucleotide
cgggactcacgcgtgagtcccgt

SEQ ID NO: 4088 - DNA, 23 bp, Artificial Sequence
  Description of Artificial Sequence: Synthetic oligonucleotide
agggactcacgcgtgagtccctg

SEQ ID NO: 4089 - DNA, 23 bp, Artificial Sequence
  Description of Artificial Sequence: Synthetic oligonucleotide
caggactcacgcgtgagtcctgg

SEQ ID NO: 4090 - DNA, 23 bp, Artificial Sequence
  Description of Artificial Sequence: Synthetic oligonucleotide
cgagactcacgcgtgagtctcgg

SEQ ID NO: 4091 - DNA, 23 bp, Artificial Sequence
  Description of Artificial Sequence: Synthetic oligonucleotide
cgggactcacgcgtgagtcccga

SEQ ID NO: 4092 - DNA, 23 bp, Artificial Sequence
  Description of Artificial Sequence: Synthetic oligonucleotide
tgggactcacgcgtgagtcccag

SEQ ID NO: 4093 - DNA, 23 bp, Artificial Sequence
  Description of Artificial Sequence: Synthetic oligonucleotide
ctggactcacgcgtgagtccagg

SEQ ID NO: 4094 - DNA, 23 bp, Artificial Sequence
  Description of Artificial Sequence: Synthetic oligonucleotide
cgtgactcacgcgtgagtcacgg

SEQ ID NO: 4095 - DNA, 23 bp, Artificial Sequence
  Description of Artificial Sequence: Synthetic oligonucleotide
ggcgactcacgcgtgagtcgccg

SEQ ID NO: 4096 - DNA, 23 bp, Artificial Sequence
  Description of Artificial Sequence: Synthetic oligonucleotide
agcgactcacgcgtgagtcgctg

SEQ ID NO: 4097 - DNA, 23 bp, Artificial Sequence
  Description of Artificial Sequence: Synthetic oligonucleotide
gacgactcacgcgtgagtcgtcg

SEQ ID NO: 4098 - DNA, 23 bp, Artificial Sequence
  Description of Artificial Sequence: Synthetic oligonucleotide
ggagactcacgcgtgagtctccg

SEQ ID NO: 4099 - DNA, 23 bp, Artificial Sequence
  Description of Artificial Sequence: Synthetic oligonucleotide
tgcgactcacgcgtgagtcgcag

SEQ ID NO: 4100 - DNA, 23 bp, Artificial Sequence
  Description of Artificial Sequence: Synthetic oligonucleotide
ggtgactcacgcgtgagtcaccg

SEQ ID NO: 4101 - DNA, 23 bp, Artificial Sequence
  Description of Artificial Sequence: Synthetic oligonucleotide
acggactcacgcgtgagtccgtg

SEQ ID NO: 4102 - DNA, 23 bp, Artificial Sequence
  Description of Artificial Sequence: Synthetic oligonucleotide
ccagactcacgcgtgagtctggg

SEQ ID NO: 4103 - DNA, 23 bp, Artificial Sequence
  Description of Artificial Sequence: Synthetic oligonucleotide
tcggactcacgcgtgagtccgag

SEQ ID NO: 4104 - DNA, 23 bp, Artificial Sequence
  Description of Artificial Sequence: Synthetic oligonucleotide
cctgactcacgcgtgagtcaggg

SEQ ID NO: 4105 - DNA, 23 bp, Artificial Sequence
  Description of Artificial Sequence: Synthetic oligonucleotide
cacgactcacgcgtgagtcgtgg

SEQ ID NO: 4106 - DNA, 23 bp, Artificial Sequence
  Description of Artificial Sequence: Synthetic oligonucleotide
gccgactcacgcgtgagtcggct

SEQ ID NO: 4107 - DNA, 23 bp, Artificial Sequence
  Description of Artificial Sequence: Synthetic oligonucleotide
gccgactcacgcgtgagtcggca

SEQ ID NO: 4108 - DNA, 23 bp, Artificial Sequence
  Description of Artificial Sequence: Synthetic oligonucleotide
cgagactcacgcgtgagtctcgc

SEQ ID NO: 4109 - DNA, 23 bp, Artificial Sequence
  Description of Artificial Sequence: Synthetic oligonucleotide
cgtgactcacgcgtgagtcacgc

SEQ ID NO: 4110 - DNA, 23 bp, Artificial Sequence
  Description of Artificial Sequence: Synthetic oligonucleotide
caggactcacgcgtgagtcctgc

SEQ ID NO: 4111 - DNA, 23 bp, Artificial Sequence
  Description of Artificial Sequence: Synthetic oligonucleotide
ctggactcacgcgtgagtccagc

SEQ ID NO: 4112 - DNA, 23 bp, Artificial Sequence
  Description of Artificial Sequence: Synthetic oligonucleotide
gaggactcacgcgtgagtcctcg

SEQ ID NO: 4113 - DNA, 23 bp, Artificial Sequence
  Description of Artificial Sequence: Synthetic oligonucleotide
gtggactcacgcgtgagtccacg

SEQ ID NO: 4114 - DNA, 23 bp, Artificial Sequence
  Description of Artificial Sequence: Synthetic oligonucleotide
accgactcacgcgtgagtcggtg

SEQ ID NO: 4115 - DNA, 23 bp, Artificial Sequence
  Description of Artificial Sequence: Synthetic oligonucleotide
tccgactcacgcgtgagtcggag

SEQ ID NO: 4116 - DNA, 23 bp, Artificial Sequence
  Description of Artificial Sequence: Synthetic oligonucleotide
cgggactcacgcgtgagtcccgc

SEQ ID NO: 4117 - DNA, 23 bp, Artificial Sequence
  Description of Artificial Sequence: Synthetic oligonucleotide
agggactcacgcgtgagtccctc

SEQ ID NO: 4118 - DNA, 23 bp, Artificial Sequence
  Description of Artificial Sequence: Synthetic oligonucleotide
tgggactcacgcgtgagtcccac

SEQ ID NO: 4119 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaccggtgagtcnnnn

SEQ ID NO: 4120 - DNA, 23 bp, Artificial Sequence
  Description of Artificial Sequence: Synthetic oligonucleotide
gcggactcaccggtgagtccgcc

SEQ ID NO: 4121 - DNA, 23 bp, Artificial Sequence
  Description of Artificial Sequence: Synthetic oligonucleotide
gcggactcaccggtgagtccgct

SEQ ID NO: 4122 - DNA, 23 bp, Artificial Sequence
  Description of Artificial Sequence: Synthetic oligonucleotide
acggactcaccggtgagtccgtc

SEQ ID NO: 4123 - DNA, 23 bp, Artificial Sequence
  Description of Artificial Sequence: Synthetic oligonucleotide
gaggactcaccggtgagtcctcc

SEQ ID NO: 4124 - DNA, 23 bp, Artificial Sequence
  Description of Artificial Sequence: Synthetic oligonucleotide
gcagactcaccggtgagtctgcc

SEQ ID NO: 4125 - DNA, 23 bp, Artificial Sequence
  Description of Artificial Sequence: Synthetic oligonucleotide
gcggactcaccggtgagtccgca

SEQ ID NO: 4126 - DNA, 23 bp, Artificial Sequence
  Description of Artificial Sequence: Synthetic oligonucleotide
tcggactcaccggtgagtccgac

SEQ ID NO: 4127 - DNA, 23 bp, Artificial Sequence
  Description of Artificial Sequence: Synthetic oligonucleotide
gtggactcaccggtgagtccacc

SEQ ID NO: 4128 - DNA, 23 bp, Artificial Sequence
  Description of Artificial Sequence: Synthetic oligonucleotide
gctgactcaccggtgagtcagcc

SEQ ID NO: 4129 - DNA, 23 bp, Artificial Sequence
  Description of Artificial Sequence: Synthetic oligonucleotide
cccgactcaccggtgagtcgggc

SEQ ID NO: 4130 - DNA, 23 bp, Artificial Sequence
  Description of Artificial Sequence: Synthetic oligonucleotide
cccgactcaccggtgagtcgggt

SEQ ID NO: 4131 - DNA, 23 bp, Artificial Sequence
  Description of Artificial Sequence: Synthetic oligonucleotide
accgactcaccggtgagtcggtc

SEQ ID NO: 4132 - DNA, 23 bp, Artificial Sequence
  Description of Artificial Sequence: Synthetic oligonucleotide
cacgactcaccggtgagtcgtgc

SEQ ID NO: 4133 - DNA, 23 bp, Artificial Sequence
  Description of Artificial Sequence: Synthetic oligonucleotide
ccagactcaccggtgagtctggc

SEQ ID NO: 4134 - DNA, 23 bp, Artificial Sequence
  Description of Artificial Sequence: Synthetic oligonucleotide
cccgactcaccggtgagtcggga

SEQ ID NO: 4135 - DNA, 23 bp, Artificial Sequence
  Description of Artificial Sequence: Synthetic oligonucleotide
tccgactcaccggtgagtcggac

SEQ ID NO: 4136 - DNA, 23 bp, Artificial Sequence
  Description of Artificial Sequence: Synthetic oligonucleotide
cctgactcaccggtgagtcaggc

SEQ ID NO: 4137 - DNA, 23 bp, Artificial Sequence
  Description of Artificial Sequence: Synthetic oligonucleotide
ggcgactcaccggtgagtcgccc

SEQ ID NO: 4138 - DNA, 23 bp, Artificial Sequence
  Description of Artificial Sequence: Synthetic oligonucleotide
ggcgactcaccggtgagtcgcct

SEQ ID NO: 4139 - DNA, 23 bp, Artificial Sequence
  Description of Artificial Sequence: Synthetic oligonucleotide
agcgactcaccggtgagtcgctc

SEQ ID NO: 4140 - DNA, 23 bp, Artificial Sequence
  Description of Artificial Sequence: Synthetic oligonucleotide
gacgactcaccggtgagtcgtcc

SEQ ID NO: 4141 - DNA, 23 bp, Artificial Sequence
  Description of Artificial Sequence: Synthetic oligonucleotide
ggagactcaccggtgagtctccc

SEQ ID NO: 4142 - DNA, 23 bp, Artificial Sequence
  Description of Artificial Sequence: Synthetic oligonucleotide
ggcgactcaccggtgagtcgcca

SEQ ID NO: 4143 - DNA, 23 bp, Artificial Sequence
  Description of Artificial Sequence: Synthetic oligonucleotide
tgcgactcaccggtgagtcgcac

SEQ ID NO: 4144 - DNA, 23 bp, Artificial Sequence
  Description of Artificial Sequence: Synthetic oligonucleotide
ggtgactcaccggtgagtcaccc

SEQ ID NO: 4145 - DNA, 23 bp, Artificial Sequence
  Description of Artificial Sequence: Synthetic oligonucleotide
cgggactcaccggtgagtcccgt

SEQ ID NO: 4146 - DNA, 23 bp, Artificial Sequence
  Description of Artificial Sequence: Synthetic oligonucleotide
agggactcaccggtgagtccctg

SEQ ID NO: 4147 - DNA, 23 bp, Artificial Sequence
  Description of Artificial Sequence: Synthetic oligonucleotide
caggactcaccggtgagtcctgg

SEQ ID NO: 4148 - DNA, 23 bp, Artificial Sequence
  Description of Artificial Sequence: Synthetic oligonucleotide
cgagactcaccggtgagtctcgg

SEQ ID NO: 4149 - DNA, 23 bp, Artificial Sequence
  Description of Artificial Sequence: Synthetic oligonucleotide
cgggactcaccggtgagtcccga

SEQ ID NO: 4150 - DNA, 23 bp, Artificial Sequence
  Description of Artificial Sequence: Synthetic oligonucleotide
tgggactcaccggtgagtcccag

SEQ ID NO: 4151 - DNA, 23 bp, Artificial Sequence
  Description of Artificial Sequence: Synthetic oligonucleotide
ctggactcaccggtgagtccagg

SEQ ID NO: 4152 - DNA, 23 bp, Artificial Sequence
  Description of Artificial Sequence: Synthetic oligonucleotide
cgtgactcaccggtgagtcacgg

SEQ ID NO: 4153 - DNA, 23 bp, Artificial Sequence
  Description of Artificial Sequence: Synthetic oligonucleotide
ggcgactcaccggtgagtcgccg

SEQ ID NO: 4154 - DNA, 23 bp, Artificial Sequence
  Description of Artificial Sequence: Synthetic oligonucleotide
agcgactcaccggtgagtcgctg

SEQ ID NO: 4155 - DNA, 23 bp, Artificial Sequence
  Description of Artificial Sequence: Synthetic oligonucleotide
gacgactcaccggtgagtcgtcg

SEQ ID NO: 4156 - DNA, 23 bp, Artificial Sequence
  Description of Artificial Sequence: Synthetic oligonucleotide
ggagactcaccggtgagtctccg

SEQ ID NO: 4157 - DNA, 23 bp, Artificial Sequence
  Description of Artificial Sequence: Synthetic oligonucleotide
tgcgactcaccggtgagtcgcag

SEQ ID NO: 4158 - DNA, 23 bp, Artificial Sequence
  Description of Artificial Sequence: Synthetic oligonucleotide
ggtgactcaccggtgagtcaccg

SEQ ID NO: 4159 - DNA, 23 bp, Artificial Sequence
  Description of Artificial Sequence: Synthetic oligonucleotide
acggactcaccggtgagtccgtg

SEQ ID NO: 4160 - DNA, 23 bp, Artificial Sequence
  Description of Artificial Sequence: Synthetic oligonucleotide
ccagactcaccggtgagtctggg

SEQ ID NO: 4161 - DNA, 23 bp, Artificial Sequence
  Description of Artificial Sequence: Synthetic oligonucleotide
tcggactcaccggtgagtccgag

SEQ ID NO: 4162 - DNA, 23 bp, Artificial Sequence
  Description of Artificial Sequence: Synthetic oligonucleotide
cctgactcaccggtgagtcaggg

SEQ ID NO: 4163 - DNA, 23 bp, Artificial Sequence
  Description of Artificial Sequence: Synthetic oligonucleotide
cacgactcaccggtgagtcgtgg

SEQ ID NO: 4164 - DNA, 23 bp, Artificial Sequence
  Description of Artificial Sequence: Synthetic oligonucleotide
gccgactcaccggtgagtcggct

SEQ ID NO: 4165 - DNA, 23 bp, Artificial Sequence
  Description of Artificial Sequence: Synthetic oligonucleotide
gccgactcaccggtgagtcggca

SEQ ID NO: 4166 - DNA, 23 bp, Artificial Sequence
  Description of Artificial Sequence: Synthetic oligonucleotide
cgagactcaccggtgagtctcgc

SEQ ID NO: 4167 - DNA, 23 bp, Artificial Sequence
  Description of Artificial Sequence: Synthetic oligonucleotide
cgtgactcaccggtgagtcacgc

SEQ ID NO: 4168 - DNA, 23 bp, Artificial Sequence
  Description of Artificial Sequence: Synthetic oligonucleotide
caggactcaccggtgagtcctgc

SEQ ID NO: 4169 - DNA, 23 bp, Artificial Sequence
  Description of Artificial Sequence: Synthetic oligonucleotide
ctggactcaccggtgagtccagc

SEQ ID NO: 4170 - DNA, 23 bp, Artificial Sequence
  Description of Artificial Sequence: Synthetic oligonucleotide
gaggactcaccggtgagtcctcg

SEQ ID NO: 4171 - DNA, 23 bp, Artificial Sequence
  Description of Artificial Sequence: Synthetic oligonucleotide
gtggactcaccggtgagtccacg

SEQ ID NO: 4172 - DNA, 23 bp, Artificial Sequence
  Description of Artificial Sequence: Synthetic oligonucleotide
accgactcaccggtgagtcggtg

SEQ ID NO: 4173 - DNA, 23 bp, Artificial Sequence
  Description of Artificial Sequence: Synthetic oligonucleotide
tccgactcaccggtgagtcggag

SEQ ID NO: 4174 - DNA, 23 bp, Artificial Sequence
  Description of Artificial Sequence: Synthetic oligonucleotide
cgggactcaccggtgagtcccgc

SEQ ID NO: 4175 - DNA, 23 bp, Artificial Sequence
  Description of Artificial Sequence: Synthetic oligonucleotide
agggactcaccggtgagtccctc

SEQ ID NO: 4176 - DNA, 23 bp, Artificial Sequence
  Description of Artificial Sequence: Synthetic oligonucleotide
tgggactcaccggtgagtcccac

SEQ ID NO: 4177 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcggatccgagtcnnnn

SEQ ID NO: 4178 - DNA, 23 bp, Artificial Sequence
  Description of Artificial Sequence: Synthetic oligonucleotide
gcggactcggatccgagtccgcc

SEQ ID NO: 4179 - DNA, 23 bp, Artificial Sequence
  Description of Artificial Sequence: Synthetic oligonucleotide
gcggactcggatccgagtccgct

SEQ ID NO: 4180 - DNA, 23 bp, Artificial Sequence
  Description of Artificial Sequence: Synthetic oligonucleotide
acggactcggatccgagtccgtc

SEQ ID NO: 4181 - DNA, 23 bp, Artificial Sequence
  Description of Artificial Sequence: Synthetic oligonucleotide
gaggactcggatccgagtcctcc

SEQ ID NO: 4182 - DNA, 23 bp, Artificial Sequence
  Description of Artificial Sequence: Synthetic oligonucleotide
gcagactcggatccgagtctgcc

SEQ ID NO: 4183 - DNA, 23 bp, Artificial Sequence
  Description of Artificial Sequence: Synthetic oligonucleotide
gcggactcggatccgagtccgca

SEQ ID NO: 4184 - DNA, 23 bp, Artificial Sequence
  Description of Artificial Sequence: Synthetic oligonucleotide
tcggactcggatccgagtccgac

SEQ ID NO: 4185 - DNA, 23 bp, Artificial Sequence
  Description of Artificial Sequence: Synthetic oligonucleotide
gtggactcggatccgagtccacc

SEQ ID NO: 4186 - DNA, 23 bp, Artificial Sequence
  Description of Artificial Sequence: Synthetic oligonucleotide
gctgactcggatccgagtcagcc

SEQ ID NO: 4187 - DNA, 23 bp, Artificial Sequence
  Description of Artificial Sequence: Synthetic oligonucleotide
cccgactcggatccgagtcgggc

SEQ ID NO: 4188 - DNA, 23 bp, Artificial Sequence
  Description of Artificial Sequence: Synthetic oligonucleotide
cccgactcggatccgagtcgggt

SEQ ID NO: 4189 - DNA, 23 bp, Artificial Sequence
  Description of Artificial Sequence: Synthetic oligonucleotide
accgactcggatccgagtcggtc

SEQ ID NO: 4190 - DNA, 23 bp, Artificial Sequence
  Description of Artificial Sequence: Synthetic oligonucleotide
cacgactcggatccgagtcgtgc

SEQ ID NO: 4191 - DNA, 23 bp, Artificial Sequence
  Description of Artificial Sequence: Synthetic oligonucleotide
ccagactcggatccgagtctggc

SEQ ID NO: 4192 - DNA, 23 bp, Artificial Sequence
  Description of Artificial Sequence: Synthetic oligonucleotide
cccgactcggatccgagtcggga

SEQ ID NO: 4193 - DNA, 23 bp, Artificial Sequence
  Description of Artificial Sequence: Synthetic oligonucleotide
tccgactcggatccgagtcggac

SEQ ID NO: 4194 - DNA, 23 bp, Artificial Sequence
  Description of Artificial Sequence: Synthetic oligonucleotide
cctgactcggatccgagtcaggc

SEQ ID NO: 4195 - DNA, 23 bp, Artificial Sequence
  Description of Artificial Sequence: Synthetic oligonucleotide
ggcgactcggatccgagtcgccc

SEQ ID NO: 4196 - DNA, 23 bp, Artificial Sequence
  Description of Artificial Sequence: Synthetic oligonucleotide
ggcgactcggatccgagtcgcct

SEQ ID NO: 4197 - DNA, 23 bp, Artificial Sequence
  Description of Artificial Sequence: Synthetic oligonucleotide
agcgactcggatccgagtcgctc

SEQ ID NO: 4198 - DNA, 23 bp, Artificial Sequence
  Description of Artificial Sequence: Synthetic oligonucleotide
gacgactcggatccgagtcgtcc

SEQ ID NO: 4199 - DNA, 23 bp, Artificial Sequence
  Description of Artificial Sequence: Synthetic oligonucleotide
ggagactcggatccgagtctccc

SEQ ID NO: 4200 - DNA, 23 bp, Artificial Sequence
  Description of Artificial Sequence: Synthetic oligonucleotide
ggcgactcggatccgagtcgcca

SEQ ID NO: 4201 - DNA, 23 bp, Artificial Sequence
  Description of Artificial Sequence: Synthetic oligonucleotide
tgcgactcggatccgagtcgcac

SEQ ID NO: 4202 - DNA, 23 bp, Artificial Sequence
  Description of Artificial Sequence: Synthetic oligonucleotide
ggtgactcggatccgagtcaccc

SEQ ID NO: 4203 - DNA, 23 bp, Artificial Sequence
  Description of Artificial Sequence: Synthetic oligonucleotide
cgggactcggatccgagtcccgt

SEQ ID NO: 4204 - DNA, 23 bp, Artificial Sequence
  Description of Artificial Sequence: Synthetic oligonucleotide
agggactcggatccgagtccctg

SEQ ID NO: 4205 - DNA, 23 bp, Artificial Sequence
  Description of Artificial Sequence: Synthetic oligonucleotide
caggactcggatccgagtcctgg

SEQ ID NO: 4206 - DNA, 23 bp, Artificial Sequence
  Description of Artificial Sequence: Synthetic oligonucleotide
cgagactcggatccgagtctcgg

SEQ ID NO: 4207 - DNA, 23 bp, Artificial Sequence
  Description of Artificial Sequence: Synthetic oligonucleotide
cgggactcggatccgagtcccga

SEQ ID NO: 4208 - DNA, 23 bp, Artificial Sequence
  Description of Artificial Sequence: Synthetic oligonucleotide
tgggactcggatccgagtcccag

SEQ ID NO: 4209 - DNA, 23 bp, Artificial Sequence
  Description of Artificial Sequence: Synthetic oligonucleotide
ctggactcggatccgagtccagg

SEQ ID NO: 4210 - DNA, 23 bp, Artificial Sequence
  Description of Artificial Sequence: Synthetic oligonucleotide
cgtgactcggatccgagtcacgg

SEQ ID NO: 4211 - DNA, 23 bp, Artificial Sequence
  Description of Artificial Sequence: Synthetic oligonucleotide
ggcgactcggatccgagtcgccg

SEQ ID NO: 4212 - DNA, 23 bp, Artificial Sequence
  Description of Artificial Sequence: Synthetic oligonucleotide
agcgactcggatccgagtcgctg

SEQ ID NO: 4213 - DNA, 23 bp, Artificial Sequence
  Description of Artificial Sequence: Synthetic oligonucleotide
gacgactcggatccgagtcgtcg

SEQ ID NO: 4214 - DNA, 23 bp, Artificial Sequence
  Description of Artificial Sequence: Synthetic oligonucleotide
ggagactcggatccgagtctccg

SEQ ID NO: 4215 - DNA, 23 bp, Artificial Sequence
  Description of Artificial Sequence: Synthetic oligonucleotide
tgcgactcggatccgagtcgcag

SEQ ID NO: 4216 - DNA, 23 bp, Artificial Sequence
  Description of Artificial Sequence: Synthetic oligonucleotide
ggtgactcggatccgagtcaccg

SEQ ID NO: 4217 - DNA, 23 bp, Artificial Sequence
  Description of Artificial Sequence: Synthetic oligonucleotide
acggactcggatccgagtccgtg

SEQ ID NO: 4218 - DNA, 23 bp, Artificial Sequence
  Description of Artificial Sequence: Synthetic oligonucleotide
ccagactcggatccgagtctggg

SEQ ID NO: 4219 - DNA, 23 bp, Artificial Sequence
  Description of Artificial Sequence: Synthetic oligonucleotide
tcggactcggatccgagtccgag

SEQ ID NO: 4220 - DNA, 23 bp, Artificial Sequence
  Description of Artificial Sequence: Synthetic oligonucleotide
cctgactcggatccgagtcaggg

SEQ ID NO: 4221 - DNA, 23 bp, Artificial Sequence
  Description of Artificial Sequence: Synthetic oligonucleotide
cacgactcggatccgagtcgtgg

SEQ ID NO: 4222 - DNA, 23 bp, Artificial Sequence
  Description of Artificial Sequence: Synthetic oligonucleotide
gccgactcggatccgagtcggct

SEQ ID NO: 4223 - DNA, 23 bp, Artificial Sequence
  Description of Artificial Sequence: Synthetic oligonucleotide
gccgactcggatccgagtcggca

SEQ ID NO: 4224 - DNA, 23 bp, Artificial Sequence
  Description of Artificial Sequence: Synthetic oligonucleotide
cgagactcggatccgagtctcgc

SEQ ID NO: 4225 - DNA, 23 bp, Artificial Sequence
  Description of Artificial Sequence: Synthetic oligonucleotide
cgtgactcggatccgagtcacgc

SEQ ID NO: 4226 - DNA, 23 bp, Artificial Sequence
  Description of Artificial Sequence: Synthetic oligonucleotide
caggactcggatccgagtcctgc

SEQ ID NO: 4227 - DNA, 23 bp, Artificial Sequence
  Description of Artificial Sequence: Synthetic oligonucleotide
ctggactcggatccgagtccagc

SEQ ID NO: 4228 - DNA, 23 bp, Artificial Sequence
  Description of Artificial Sequence: Synthetic oligonucleotide
gaggactcggatccgagtcctcg

SEQ ID NO: 4229 - DNA, 23 bp, Artificial Sequence
  Description of Artificial Sequence: Synthetic oligonucleotide
gtggactcggatccgagtccacg

SEQ ID NO: 4230 - DNA, 23 bp, Artificial Sequence
  Description of Artificial Sequence: Synthetic oligonucleotide
accgactcggatccgagtcggtg

SEQ ID NO: 4231 - DNA, 23 bp, Artificial Sequence
  Description of Artificial Sequence: Synthetic oligonucleotide
tccgactcggatccgagtcggag

SEQ ID NO: 4232 - DNA, 23 bp, Artificial Sequence
  Description of Artificial Sequence: Synthetic oligonucleotide
cgggactcggatccgagtcccgc

SEQ ID NO: 4233 - DNA, 23 bp, Artificial Sequence
  Description of Artificial Sequence: Synthetic oligonucleotide
agggactcggatccgagtccctc

SEQ ID NO: 4234 - DNA, 23 bp, Artificial Sequence
  Description of Artificial Sequence: Synthetic oligonucleotide
tgggactcggatccgagtcccac

SEQ ID NO: 4235 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcggtaccgagtcnnnn

SEQ ID NO: 4236 - DNA, 23 bp, Artificial Sequence
  Description of Artificial Sequence: Synthetic oligonucleotide
gcggactcggtaccgagtccgcc

SEQ ID NO: 4237 - DNA, 23 bp, Artificial Sequence
  Description of Artificial Sequence: Synthetic oligonucleotide
gcggactcggtaccgagtccgct

SEQ ID NO: 4238 - DNA, 23 bp, Artificial Sequence
  Description of Artificial Sequence: Synthetic oligonucleotide
acggactcggtaccgagtccgtc

SEQ ID NO: 4239 - DNA, 23 bp, Artificial Sequence
  Description of Artificial Sequence: Synthetic oligonucleotide
gaggactcggtaccgagtcctcc

SEQ ID NO: 4240 - DNA, 23 bp, Artificial Sequence
  Description of Artificial Sequence: Synthetic oligonucleotide
gcagactcggtaccgagtctgcc

SEQ ID NO: 4241 - DNA, 23 bp, Artificial Sequence
  Description of Artificial Sequence: Synthetic oligonucleotide
gcggactcggtaccgagtccgca

SEQ ID NO: 4242 - DNA, 23 bp, Artificial Sequence
  Description of Artificial Sequence: Synthetic oligonucleotide
tcggactcggtaccgagtccgac

SEQ ID NO: 4243 - DNA, 23 bp, Artificial Sequence
  Description of Artificial Sequence: Synthetic oligonucleotide
gtggactcggtaccgagtccacc

SEQ ID NO: 4244 - DNA, 23 bp, Artificial Sequence
  Description of Artificial Sequence: Synthetic oligonucleotide
gctgactcggtaccgagtcagcc

SEQ ID NO: 4245 - DNA, 23 bp, Artificial Sequence
  Description of Artificial Sequence: Synthetic oligonucleotide
cccgactcggtaccgagtcgggc

SEQ ID NO: 4246 - DNA, 23 bp, Artificial Sequence
  Description of Artificial Sequence: Synthetic oligonucleotide
cccgactcggtaccgagtcgggt

SEQ ID NO: 4247 - DNA, 23 bp, Artificial Sequence
  Description of Artificial Sequence: Synthetic oligonucleotide
accgactcggtaccgagtcggtc

SEQ ID NO: 4248 - DNA, 23 bp, Artificial Sequence
  Description of Artificial Sequence: Synthetic oligonucleotide
cacgactcggtaccgagtcgtgc

SEQ ID NO: 4249 - DNA, 23 bp, Artificial Sequence
  Description of Artificial Sequence: Synthetic oligonucleotide
ccagactcggtaccgagtctggc

SEQ ID NO: 4250 - DNA, 23 bp, Artificial Sequence
  Description of Artificial Sequence: Synthetic oligonucleotide
cccgactcggtaccgagtcggga

SEQ ID NO: 4251 - DNA, 23 bp, Artificial Sequence
  Description of Artificial Sequence: Synthetic oligonucleotide
tccgactcggtaccgagtcggac

SEQ ID NO: 4252 - DNA, 23 bp, Artificial Sequence
  Description of Artificial Sequence: Synthetic oligonucleotide
cctgactcggtaccgagtcaggc

SEQ ID NO: 4253 - DNA, 23 bp, Artificial Sequence
  Description of Artificial Sequence: Synthetic oligonucleotide
ggcgactcggtaccgagtcgccc

SEQ ID NO: 4254 - DNA, 23 bp, Artificial Sequence
  Description of Artificial Sequence: Synthetic oligonucleotide
ggcgactcggtaccgagtcgcct

SEQ ID NO: 4255 - DNA, 23 bp, Artificial Sequence
  Description of Artificial Sequence: Synthetic oligonucleotide
agcgactcggtaccgagtcgctc

SEQ ID NO: 4256 - DNA, 23 bp, Artificial Sequence
  Description of Artificial Sequence: Synthetic oligonucleotide
gacgactcggtaccgagtcgtcc

SEQ ID NO: 4257 - DNA, 23 bp, Artificial Sequence
  Description of Artificial Sequence: Synthetic oligonucleotide
ggagactcggtaccgagtctccc

SEQ ID NO: 4258 - DNA, 23 bp, Artificial Sequence
  Description of Artificial Sequence: Synthetic oligonucleotide
ggcgactcggtaccgagtcgcca

SEQ ID NO: 4259 - DNA, 23 bp, Artificial Sequence
  Description of Artificial Sequence: Synthetic oligonucleotide
tgcgactcggtaccgagtcgcac

SEQ ID NO: 4260 - DNA, 23 bp, Artificial Sequence
  Description of Artificial Sequence: Synthetic oligonucleotide
ggtgactcggtaccgagtcaccc

SEQ ID NO: 4261 - DNA, 23 bp, Artificial Sequence
  Description of Artificial Sequence: Synthetic oligonucleotide
cgggactcggtaccgagtcccgt

SEQ ID NO: 4262 - DNA, 23 bp, Artificial Sequence
  Description of Artificial Sequence: Synthetic oligonucleotide
agggactcggtaccgagtccctg

SEQ ID NO: 4263 - DNA, 23 bp, Artificial Sequence
  Description of Artificial Sequence: Synthetic oligonucleotide
caggactcggtaccgagtcctgg

SEQ ID NO: 4264 - DNA, 23 bp, Artificial Sequence
  Description of Artificial Sequence: Synthetic oligonucleotide
cgagactcggtaccgagtctcgg

SEQ ID NO: 4265 - DNA, 23 bp, Artificial Sequence
  Description of Artificial Sequence: Synthetic oligonucleotide
cgggactcggtaccgagtcccga

SEQ ID NO: 4266 - DNA, 23 bp, Artificial Sequence
  Description of Artificial Sequence: Synthetic oligonucleotide
tgggactcggtaccgagtcccag

SEQ ID NO: 4267 - DNA, 23 bp, Artificial Sequence
  Description of Artificial Sequence: Synthetic oligonucleotide
ctggactcggtaccgagtccagg

SEQ ID NO: 4268 - DNA, 23 bp, Artificial Sequence
  Description of Artificial Sequence: Synthetic oligonucleotide
cgtgactcggtaccgagtcacgg

SEQ ID NO: 4269 - DNA, 23 bp, Artificial Sequence
  Description of Artificial Sequence: Synthetic oligonucleotide
ggcgactcggtaccgagtcgccg

SEQ ID NO: 4270 - DNA, 23 bp, Artificial Sequence
  Description of Artificial Sequence: Synthetic oligonucleotide
agcgactcggtaccgagtcgctg

SEQ ID NO: 4271 - DNA, 23 bp, Artificial Sequence
  Description of Artificial Sequence: Synthetic oligonucleotide
gacgactcggtaccgagtcgtcg

SEQ ID NO: 4272 - DNA, 23 bp, Artificial Sequence
  Description of Artificial Sequence: Synthetic oligonucleotide
ggagactcggtaccgagtctccg

SEQ ID NO: 4273 - DNA, 23 bp, Artificial Sequence
  Description of Artificial Sequence: Synthetic oligonucleotide
tgcgactcggtaccgagtcgcag

SEQ ID NO: 4274 - DNA, 23 bp, Artificial Sequence
  Description of Artificial Sequence: Synthetic oligonucleotide
ggtgactcggtaccgagtcaccg

SEQ ID NO: 4275 - DNA, 23 bp, Artificial Sequence
  Description of Artificial Sequence: Synthetic oligonucleotide
acggactcggtaccgagtccgtg

SEQ ID NO: 4276 - DNA, 23 bp, Artificial Sequence
  Description of Artificial Sequence: Synthetic oligonucleotide
ccagactcggtaccgagtctggg

SEQ ID NO: 4277 - DNA, 23 bp, Artificial Sequence
  Description of Artificial Sequence: Synthetic oligonucleotide
tcggactcggtaccgagtccgag

SEQ ID NO: 4278 - DNA, 23 bp, Artificial Sequence
  Description of Artificial Sequence: Synthetic oligonucleotide
cctgactcggtaccgagtcaggg

SEQ ID NO: 4279 - DNA, 23 bp, Artificial Sequence
  Description of Artificial Sequence: Synthetic oligonucleotide
cacgactcggtaccgagtcgtgg

SEQ ID NO: 4280 - DNA, 23 bp, Artificial Sequence
  Description of Artificial Sequence: Synthetic oligonucleotide
gccgactcggtaccgagtcggct

SEQ ID NO: 4281 - DNA, 23 bp, Artificial Sequence
  Description of Artificial Sequence: Synthetic oligonucleotide
gccgactcggtaccgagtcggca

SEQ ID NO: 4282 - DNA, 23 bp, Artificial Sequence
  Description of Artificial Sequence: Synthetic oligonucleotide
cgagactcggtaccgagtctcgc

SEQ ID NO: 4283 - DNA, 23 bp, Artificial Sequence
  Description of Artificial Sequence: Synthetic oligonucleotide
cgtgactcggtaccgagtcacgc

SEQ ID NO: 4284 - DNA, 23 bp, Artificial Sequence
  Description of Artificial Sequence: Synthetic oligonucleotide
caggactcggtaccgagtcctgc

SEQ ID NO: 4285 - DNA, 23 bp, Artificial Sequence
  Description of Artificial Sequence: Synthetic oligonucleotide
ctggactcggtaccgagtccagc

SEQ ID NO: 4286 - DNA, 23 bp, Artificial Sequence
  Description of Artificial Sequence: Synthetic oligonucleotide
gaggactcggtaccgagtcctcg

SEQ ID NO: 4287 - DNA, 23 bp, Artificial Sequence
  Description of Artificial Sequence: Synthetic oligonucleotide
gtggactcggtaccgagtccacg

SEQ ID NO: 4288 - DNA, 23 bp, Artificial Sequence
  Description of Artificial Sequence: Synthetic oligonucleotide
accgactcggtaccgagtcggtg

SEQ ID NO: 4289 - DNA, 23 bp, Artificial Sequence
  Description of Artificial Sequence: Synthetic oligonucleotide
tccgactcggtaccgagtcggag

SEQ ID NO: 4290 - DNA, 23 bp, Artificial Sequence
  Description of Artificial Sequence: Synthetic oligonucleotide
cgggactcggtaccgagtcccgc

SEQ ID NO: 4291 - DNA, 23 bp, Artificial Sequence
  Description of Artificial Sequence: Synthetic oligonucleotide
agggactcggtaccgagtccctc

SEQ ID NO: 4292 - DNA, 23 bp, Artificial Sequence
  Description of Artificial Sequence: Synthetic oligonucleotide
tgggactcggtaccgagtcccac

SEQ ID NO: 4293 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgggcccgagtcnnnn

SEQ ID NO: 4294 - DNA, 23 bp, Artificial Sequence
  Description of Artificial Sequence: Synthetic oligonucleotide
gcggactcgggcccgagtccgcc

SEQ ID NO: 4295 - DNA, 23 bp, Artificial Sequence
  Description of Artificial Sequence: Synthetic oligonucleotide
gcggactcgggcccgagtccgct

SEQ ID NO: 4296 - DNA, 23 bp, Artificial Sequence
  Description of Artificial Sequence: Synthetic oligonucleotide
acggactcgggcccgagtccgtc

SEQ ID NO: 4297 - DNA, 23 bp, Artificial Sequence
  Description of Artificial Sequence: Synthetic oligonucleotide
gaggactcgggcccgagtcctcc

SEQ ID NO: 4298 - DNA, 23 bp, Artificial Sequence
  Description of Artificial Sequence: Synthetic oligonucleotide
gcagactcgggcccgagtctgcc

SEQ ID NO: 4299 - DNA, 23 bp, Artificial Sequence
  Description of Artificial Sequence: Synthetic oligonucleotide
gcggactcgggcccgagtccgca

SEQ ID NO: 4300 - DNA, 23 bp, Artificial Sequence
  Description of Artificial Sequence: Synthetic oligonucleotide
tcggactcgggcccgagtccgac

SEQ ID NO: 4301 - DNA, 23 bp, Artificial Sequence
  Description of Artificial Sequence: Synthetic oligonucleotide
gtggactcgggcccgagtccacc

SEQ ID NO: 4302 - DNA, 23 bp, Artificial Sequence
  Description of Artificial Sequence: Synthetic oligonucleotide
gctgactcgggcccgagtcagcc

SEQ ID NO: 4303 - DNA, 23 bp, Artificial Sequence
  Description of Artificial Sequence: Synthetic oligonucleotide
cccgactcgggcccgagtcgggc

SEQ ID NO: 4304 - DNA, 23 bp, Artificial Sequence
  Description of Artificial Sequence: Synthetic oligonucleotide
cccgactcgggcccgagtcgggt

SEQ ID NO: 4305 - DNA, 23 bp, Artificial Sequence
  Description of Artificial Sequence: Synthetic oligonucleotide
accgactcgggcccgagtcggtc

SEQ ID NO: 4306 - DNA, 23 bp, Artificial Sequence
  Description of Artificial Sequence: Synthetic oligonucleotide
cacgactcgggcccgagtcgtgc

SEQ ID NO: 4307 - DNA, 23 bp, Artificial Sequence
  Description of Artificial Sequence: Synthetic oligonucleotide
ccagactcgggcccgagtctggc

SEQ ID NO: 4308 - DNA, 23 bp, Artificial Sequence
  Description of Artificial Sequence: Synthetic oligonucleotide
cccgactcgggcccgagtcggga

SEQ ID NO: 4309 - DNA, 23 bp, Artificial Sequence
  Description of Artificial Sequence: Synthetic oligonucleotide
tccgactcgggcccgagtcggac

SEQ ID NO: 4310 - DNA, 23 bp, Artificial Sequence
  Description of Artificial Sequence: Synthetic oligonucleotide
cctgactcgggcccgagtcaggc

SEQ ID NO: 4311 - DNA, 23 bp, Artificial Sequence
  Description of Artificial Sequence: Synthetic oligonucleotide
ggcgactcgggcccgagtcgccc

SEQ ID NO: 4312 - DNA, 23 bp, Artificial Sequence
  Description of Artificial Sequence: Synthetic oligonucleotide
ggcgactcgggcccgagtcgcct

SEQ ID NO: 4313 - DNA, 23 bp, Artificial Sequence
  Description of Artificial Sequence: Synthetic oligonucleotide
agcgactcgggcccgagtcgctc

SEQ ID NO: 4314 - DNA, 23 bp, Artificial Sequence
  Description of Artificial Sequence: Synthetic oligonucleotide
gacgactcgggcccgagtcgtcc

SEQ ID NO: 4315 - DNA, 23 bp, Artificial Sequence
  Description of Artificial Sequence: Synthetic oligonucleotide
ggagactcgggcccgagtctccc

SEQ ID NO: 4316 - DNA, 23 bp, Artificial Sequence
  Description of Artificial Sequence: Synthetic oligonucleotide
ggcgactcgggcccgagtcgcca

SEQ ID NO: 4317 - DNA, 23 bp, Artificial Sequence
  Description of Artificial Sequence: Synthetic oligonucleotide
tgcgactcgggcccgagtcgcac

SEQ ID NO: 4318 - DNA, 23 bp, Artificial Sequence
  Description of Artificial Sequence: Synthetic oligonucleotide
ggtgactcgggcccgagtcaccc

SEQ ID NO: 4319 - DNA, 23 bp, Artificial Sequence
  Description of Artificial Sequence: Synthetic oligonucleotide
cgggactcgggcccgagtcccgt

SEQ ID NO: 4320 - DNA, 23 bp, Artificial Sequence
  Description of Artificial Sequence: Synthetic oligonucleotide
agggactcgggcccgagtccctg

SEQ ID NO: 4321 - DNA, 23 bp, Artificial Sequence
  Description of Artificial Sequence: Synthetic oligonucleotide
caggactcgggcccgagtcctgg

SEQ ID NO: 4322 - DNA, 23 bp, Artificial Sequence
  Description of Artificial Sequence: Synthetic oligonucleotide
cgagactcgggcccgagtctcgg

SEQ ID NO: 4323 - DNA, 23 bp, Artificial Sequence
  Description of Artificial Sequence: Synthetic oligonucleotide
cgggactcgggcccgagtcccga

SEQ ID NO: 4324 - DNA, 23 bp, Artificial Sequence
  Description of Artificial Sequence: Synthetic oligonucleotide
tgggactcgggcccgagtcccag

SEQ ID NO: 4325 - DNA, 23 bp, Artificial Sequence
  Description of Artificial Sequence: Synthetic oligonucleotide
ctggactcgggcccgagtccagg

SEQ ID NO: 4326 - DNA, 23 bp, Artificial Sequence
  Description of Artificial Sequence: Synthetic oligonucleotide
cgtgactcgggcccgagtcacgg

SEQ ID NO: 4327 - DNA, 23 bp, Artificial Sequence
  Description of Artificial Sequence: Synthetic oligonucleotide
ggcgactcgggcccgagtcgccg

SEQ ID NO: 4328 - DNA, 23 bp, Artificial Sequence
  Description of Artificial Sequence: Synthetic oligonucleotide
agcgactcgggcccgagtcgctg

SEQ ID NO: 4329 - DNA, 23 bp, Artificial Sequence
  Description of Artificial Sequence: Synthetic oligonucleotide
gacgactcgggcccgagtcgtcg

SEQ ID NO: 4330 - DNA, 23 bp, Artificial Sequence
  Description of Artificial Sequence: Synthetic oligonucleotide
ggagactcgggcccgagtctccg

SEQ ID NO: 4331 - DNA, 23 bp, Artificial Sequence
  Description of Artificial Sequence: Synthetic oligonucleotide
tgcgactcgggcccgagtcgcag

SEQ ID NO: 4332 - DNA, 23 bp, Artificial Sequence
  Description of Artificial Sequence: Synthetic oligonucleotide
ggtgactcgggcccgagtcaccg

SEQ ID NO: 4333 - DNA, 23 bp, Artificial Sequence
  Description of Artificial Sequence: Synthetic oligonucleotide
acggactcgggcccgagtccgtg

SEQ ID NO: 4334 - DNA, 23 bp, Artificial Sequence
  Description of Artificial Sequence: Synthetic oligonucleotide
ccagactcgggcccgagtctggg

SEQ ID NO: 4335 - DNA, 23 bp, Artificial Sequence
  Description of Artificial Sequence: Synthetic oligonucleotide
tcggactcgggcccgagtccgag

SEQ ID NO: 4336 - DNA, 23 bp, Artificial Sequence
  Description of Artificial Sequence: Synthetic oligonucleotide
cctgactcgggcccgagtcaggg

SEQ ID NO: 4337 - DNA, 23 bp, Artificial Sequence
  Description of Artificial Sequence: Synthetic oligonucleotide
cacgactcgggcccgagtcgtgg

SEQ ID NO: 4338 - DNA, 23 bp, Artificial Sequence
  Description of Artificial Sequence: Synthetic oligonucleotide
gccgactcgggcccgagtcggct

SEQ ID NO: 4339 - DNA, 23 bp, Artificial Sequence
  Description of Artificial Sequence: Synthetic oligonucleotide
gccgactcgggcccgagtcggca

SEQ ID NO: 4340 - DNA, 23 bp, Artificial Sequence
  Description of Artificial Sequence: Synthetic oligonucleotide
cgagactcgggcccgagtctcgc

SEQ ID NO: 4341 - DNA, 23 bp, Artificial Sequence
  Description of Artificial Sequence: Synthetic oligonucleotide
cgtgactcgggcccgagtcacgc

SEQ ID NO: 4342 - DNA, 23 bp, Artificial Sequence
  Description of Artificial Sequence: Synthetic oligonucleotide
caggactcgggcccgagtcctgc

SEQ ID NO: 4343 - DNA, 23 bp, Artificial Sequence
  Description of Artificial Sequence: Synthetic oligonucleotide
ctggactcgggcccgagtccagc

SEQ ID NO: 4344 - DNA, 23 bp, Artificial Sequence
  Description of Artificial Sequence: Synthetic oligonucleotide
gaggactcgggcccgagtcctcg

SEQ ID NO: 4345 - DNA, 23 bp, Artificial Sequence
  Description of Artificial Sequence: Synthetic oligonucleotide
gtggactcgggcccgagtccacg

SEQ ID NO: 4346 - DNA, 23 bp, Artificial Sequence
  Description of Artificial Sequence: Synthetic oligonucleotide
accgactcgggcccgagtcggtg

SEQ ID NO: 4347 - DNA, 23 bp, Artificial Sequence
  Description of Artificial Sequence: Synthetic oligonucleotide
tccgactcgggcccgagtcggag

SEQ ID NO: 4348 - DNA, 23 bp, Artificial Sequence
  Description of Artificial Sequence: Synthetic oligonucleotide
cgggactcgggcccgagtcccgc

SEQ ID NO: 4349 - DNA, 23 bp, Artificial Sequence
  Description of Artificial Sequence: Synthetic oligonucleotide
agggactcgggcccgagtccctc

SEQ ID NO: 4350 - DNA, 23 bp, Artificial Sequence
  Description of Artificial Sequence: Synthetic oligonucleotide
tgggactcgggcccgagtcccac

SEQ ID NO: 4351 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcggcgccgagtcnnnn

SEQ ID NO: 4352 - DNA, 23 bp, Artificial Sequence
  Description of Artificial Sequence: Synthetic oligonucleotide
gcggactcggcgccgagtccgcc

SEQ ID NO: 4353 - DNA, 23 bp, Artificial Sequence
  Description of Artificial Sequence: Synthetic oligonucleotide
gcggactcggcgccgagtccgct

SEQ ID NO: 4354 - DNA, 23 bp, Artificial Sequence
  Description of Artificial Sequence: Synthetic oligonucleotide
acggactcggcgccgagtccgtc

SEQ ID NO: 4355 - DNA, 23 bp, Artificial Sequence
  Description of Artificial Sequence: Synthetic oligonucleotide
gaggactcggcgccgagtcctcc

SEQ ID NO: 4356 - DNA, 23 bp, Artificial Sequence
  Description of Artificial Sequence: Synthetic oligonucleotide
gcagactcggcgccgagtctgcc

SEQ ID NO: 4357 - DNA, 23 bp, Artificial Sequence
  Description of Artificial Sequence: Synthetic oligonucleotide
gcggactcggcgccgagtccgca

SEQ ID NO: 4358 - DNA, 23 bp, Artificial Sequence
  Description of Artificial Sequence: Synthetic oligonucleotide
tcggactcggcgccgagtccgac

SEQ ID NO: 4359 - DNA, 23 bp, Artificial Sequence
  Description of Artificial Sequence: Synthetic oligonucleotide
gtggactcggcgccgagtccacc

SEQ ID NO: 4360 - DNA, 23 bp, Artificial Sequence
  Description of Artificial Sequence: Synthetic oligonucleotide
gctgactcggcgccgagtcagcc

SEQ ID NO: 4361 - DNA, 23 bp, Artificial Sequence
  Description of Artificial Sequence: Synthetic oligonucleotide
cccgactcggcgccgagtcgggc

SEQ ID NO: 4362 - DNA, 23 bp, Artificial Sequence
  Description of Artificial Sequence: Synthetic oligonucleotide
cccgactcggcgccgagtcgggt

SEQ ID NO: 4363 - DNA, 23 bp, Artificial Sequence
  Description of Artificial Sequence: Synthetic oligonucleotide
accgactcggcgccgagtcggtc

SEQ ID NO: 4364 - DNA, 23 bp, Artificial Sequence
  Description of Artificial Sequence: Synthetic oligonucleotide
cacgactcggcgccgagtcgtgc

SEQ ID NO: 4365 - DNA, 23 bp, Artificial Sequence
  Description of Artificial Sequence: Synthetic oligonucleotide
ccagactcggcgccgagtctggc

SEQ ID NO: 4366 - DNA, 23 bp, Artificial Sequence
  Description of Artificial Sequence: Synthetic oligonucleotide
cccgactcggcgccgagtcggga

SEQ ID NO: 4367 - DNA, 23 bp, Artificial Sequence
  Description of Artificial Sequence: Synthetic oligonucleotide
tccgactcggcgccgagtcggac

SEQ ID NO: 4368 - DNA, 23 bp, Artificial Sequence
  Description of Artificial Sequence: Synthetic oligonucleotide
cctgactcggcgccgagtcaggc

SEQ ID NO: 4369 - DNA, 23 bp, Artificial Sequence
  Description of Artificial Sequence: Synthetic oligonucleotide
ggcgactcggcgccgagtcgccc

SEQ ID NO: 4370 - DNA, 23 bp, Artificial Sequence
  Description of Artificial Sequence: Synthetic oligonucleotide
ggcgactcggcgccgagtcgcct

SEQ ID NO: 4371 - DNA, 23 bp, Artificial Sequence
  Description of Artificial Sequence: Synthetic oligonucleotide
agcgactcggcgccgagtcgctc

SEQ ID NO: 4372 - DNA, 23 bp, Artificial Sequence
  Description of Artificial Sequence: Synthetic oligonucleotide
gacgactcggcgccgagtcgtcc

SEQ ID NO: 4373 - DNA, 23 bp, Artificial Sequence
  Description of Artificial Sequence: Synthetic oligonucleotide
ggagactcggcgccgagtctccc

SEQ ID NO: 4374 - DNA, 23 bp, Artificial Sequence
  Description of Artificial Sequence: Synthetic oligonucleotide
ggcgactcggcgccgagtcgcca

SEQ ID NO: 4375 - DNA, 23 bp, Artificial Sequence
  Description of Artificial Sequence: Synthetic oligonucleotide
tgcgactcggcgccgagtcgcac

SEQ ID NO: 4376 - DNA, 23 bp, Artificial Sequence
  Description of Artificial Sequence: Synthetic oligonucleotide
ggtgactcggcgccgagtcaccc

SEQ ID NO: 4377 - DNA, 23 bp, Artificial Sequence
  Description of Artificial Sequence: Synthetic oligonucleotide
cgggactcggcgccgagtcccgt

SEQ ID NO: 4378 - DNA, 23 bp, Artificial Sequence
  Description of Artificial Sequence: Synthetic oligonucleotide
agggactcggcgccgagtccctg

SEQ ID NO: 4379 - DNA, 23 bp, Artificial Sequence
  Description of Artificial Sequence: Synthetic oligonucleotide
caggactcggcgccgagtcctgg

SEQ ID NO: 4380 - DNA, 23 bp, Artificial Sequence
  Description of Artificial Sequence: Synthetic oligonucleotide
cgagactcggcgccgagtctcgg

SEQ ID NO: 4381 - DNA, 23 bp, Artificial Sequence
  Description of Artificial Sequence: Synthetic oligonucleotide
cgggactcggcgccgagtcccga

SEQ ID NO: 4382 - DNA, 23 bp, Artificial Sequence
  Description of Artificial Sequence: Synthetic oligonucleotide
tgggactcggcgccgagtcccag

SEQ ID NO: 4383 - DNA, 23 bp, Artificial Sequence
  Description of Artificial Sequence: Synthetic oligonucleotide
ctggactcggcgccgagtccagg

SEQ ID NO: 4384 - DNA, 23 bp, Artificial Sequence
  Description of Artificial Sequence: Synthetic oligonucleotide
cgtgactcggcgccgagtcacgg

SEQ ID NO: 4385 - DNA, 23 bp, Artificial Sequence
  Description of Artificial Sequence: Synthetic oligonucleotide
ggcgactcggcgccgagtcgccg

SEQ ID NO: 4386 - DNA, 23 bp, Artificial Sequence
  Description of Artificial Sequence: Synthetic oligonucleotide
agcgactcggcgccgagtcgctg

SEQ ID NO: 4387 - DNA, 23 bp, Artificial Sequence
  Description of Artificial Sequence: Synthetic oligonucleotide
gacgactcggcgccgagtcgtcg

SEQ ID NO: 4388 - DNA, 23 bp, Artificial Sequence
  Description of Artificial Sequence: Synthetic oligonucleotide
ggagactcggcgccgagtctccg

SEQ ID NO: 4389 - DNA, 23 bp, Artificial Sequence
  Description of Artificial Sequence: Synthetic oligonucleotide
tgcgactcggcgccgagtcgcag

SEQ ID NO: 4390 - DNA, 23 bp, Artificial Sequence
  Description of Artificial Sequence: Synthetic oligonucleotide
ggtgactcggcgccgagtcaccg

SEQ ID NO: 4391 - DNA, 23 bp, Artificial Sequence
  Description of Artificial Sequence: Synthetic oligonucleotide
acggactcggcgccgagtccgtg

SEQ ID NO: 4392 - DNA, 23 bp, Artificial Sequence
  Description of Artificial Sequence: Synthetic oligonucleotide
ccagactcggcgccgagtctggg

SEQ ID NO: 4393 - DNA, 23 bp, Artificial Sequence
  Description of Artificial Sequence: Synthetic oligonucleotide
tcggactcggcgccgagtccgag

SEQ ID NO: 4394 - DNA, 23 bp, Artificial Sequence
  Description of Artificial Sequence: Synthetic oligonucleotide
cctgactcggcgccgagtcaggg

SEQ ID NO: 4395 - DNA, 23 bp, Artificial Sequence
  Description of Artificial Sequence: Synthetic oligonucleotide
cacgactcggcgccgagtcgtgg

SEQ ID NO: 4396 - DNA, 23 bp, Artificial Sequence
  Description of Artificial Sequence: Synthetic oligonucleotide
gccgactcggcgccgagtcggct

SEQ ID NO: 4397 - DNA, 23 bp, Artificial Sequence
  Description of Artificial Sequence: Synthetic oligonucleotide
gccgactcggcgccgagtcggca

SEQ ID NO: 4398 - DNA, 23 bp, Artificial Sequence
  Description of Artificial Sequence: Synthetic oligonucleotide
cgagactcggcgccgagtctcgc

SEQ ID NO: 4399 - DNA, 23 bp, Artificial Sequence
  Description of Artificial Sequence: Synthetic oligonucleotide
cgtgactcggcgccgagtcacgc

SEQ ID NO: 4400 - DNA, 23 bp, Artificial Sequence
  Description of Artificial Sequence: Synthetic oligonucleotide
caggactcggcgccgagtcctgc

SEQ ID NO: 4401 - DNA, 23 bp, Artificial Sequence
  Description of Artificial Sequence: Synthetic oligonucleotide
ctggactcggcgccgagtccagc

SEQ ID NO: 4402 - DNA, 23 bp, Artificial Sequence
  Description of Artificial Sequence: Synthetic oligonucleotide
gaggactcggcgccgagtcctcg

SEQ ID NO: 4403 - DNA, 23 bp, Artificial Sequence
  Description of Artificial Sequence: Synthetic oligonucleotide
gtggactcggcgccgagtccacg

SEQ ID NO: 4404 - DNA, 23 bp, Artificial Sequence
  Description of Artificial Sequence: Synthetic oligonucleotide
accgactcggcgccgagtcggtg

SEQ ID NO: 4405 - DNA, 23 bp, Artificial Sequence
  Description of Artificial Sequence: Synthetic oligonucleotide
tccgactcggcgccgagtcggag

SEQ ID NO: 4406 - DNA, 23 bp, Artificial Sequence
  Description of Artificial Sequence: Synthetic oligonucleotide
cgggactcggcgccgagtcccgc

SEQ ID NO: 4407 - DNA, 23 bp, Artificial Sequence
  Description of Artificial Sequence: Synthetic oligonucleotide
agggactcggcgccgagtccctc

SEQ ID NO: 4408 - DNA, 23 bp, Artificial Sequence
  Description of Artificial Sequence: Synthetic oligonucleotide
tgggactcggcgccgagtcccac

SEQ ID NO: 4409 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcccatgggagtcnnnn

SEQ ID NO: 4410 - DNA, 23 bp, Artificial Sequence
  Description of Artificial Sequence: Synthetic oligonucleotide
gcggactcccatgggagtccgcc

SEQ ID NO: 4411 - DNA, 23 bp, Artificial Sequence
  Description of Artificial Sequence: Synthetic oligonucleotide
gcggactcccatgggagtccgct

SEQ ID NO: 4412 - DNA, 23 bp, Artificial Sequence
  Description of Artificial Sequence: Synthetic oligonucleotide
acggactcccatgggagtccgtc

SEQ ID NO: 4413 - DNA, 23 bp, Artificial Sequence
  Description of Artificial Sequence: Synthetic oligonucleotide
gaggactcccatgggagtcctcc

SEQ ID NO: 4414 - DNA, 23 bp, Artificial Sequence
  Description of Artificial Sequence: Synthetic oligonucleotide
gcagactcccatgggagtctgcc

SEQ ID NO: 4415 - DNA, 23 bp, Artificial Sequence
  Description of Artificial Sequence: Synthetic oligonucleotide
gcggactcccatgggagtccgca

SEQ ID NO: 4416 - DNA, 23 bp, Artificial Sequence
  Description of Artificial Sequence: Synthetic oligonucleotide
tcggactcccatgggagtccgac

SEQ ID NO: 4417 - DNA, 23 bp, Artificial Sequence
  Description of Artificial Sequence: Synthetic oligonucleotide
gtggactcccatgggagtccacc

SEQ ID NO: 4418 - DNA, 23 bp, Artificial Sequence
  Description of Artificial Sequence: Synthetic oligonucleotide
gctgactcccatgggagtcagcc

SEQ ID NO: 4419 - DNA, 23 bp, Artificial Sequence
  Description of Artificial Sequence: Synthetic oligonucleotide
cccgactcccatgggagtcgggc

SEQ ID NO: 4420 - DNA, 23 bp, Artificial Sequence
  Description of Artificial Sequence: Synthetic oligonucleotide
cccgactcccatgggagtcgggt

SEQ ID NO: 4421 - DNA, 23 bp, Artificial Sequence
  Description of Artificial Sequence: Synthetic oligonucleotide
accgactcccatgggagtcggtc

SEQ ID NO: 4422 - DNA, 23 bp, Artificial Sequence
  Description of Artificial Sequence: Synthetic oligonucleotide
cacgactcccatgggagtcgtgc

SEQ ID NO: 4423 - DNA, 23 bp, Artificial Sequence
  Description of Artificial Sequence: Synthetic oligonucleotide
ccagactcccatgggagtctggc

SEQ ID NO: 4424 - DNA, 23 bp, Artificial Sequence
  Description of Artificial Sequence: Synthetic oligonucleotide
cccgactcccatgggagtcggga

SEQ ID NO: 4425 - DNA, 23 bp, Artificial Sequence
  Description of Artificial Sequence: Synthetic oligonucleotide
tccgactcccatgggagtcggac

SEQ ID NO: 4426 - DNA, 23 bp, Artificial Sequence
  Description of Artificial Sequence: Synthetic oligonucleotide
cctgactcccatgggagtcaggc

SEQ ID NO: 4427 - DNA, 23 bp, Artificial Sequence
  Description of Artificial Sequence: Synthetic oligonucleotide
ggcgactcccatgggagtcgccc

SEQ ID NO: 4428 - DNA, 23 bp, Artificial Sequence
  Description of Artificial Sequence: Synthetic oligonucleotide
ggcgactcccatgggagtcgcct

SEQ ID NO: 4429 - DNA, 23 bp, Artificial Sequence
  Description of Artificial Sequence: Synthetic oligonucleotide
agcgactcccatgggagtcgctc

SEQ ID NO: 4430 - DNA, 23 bp, Artificial Sequence
  Description of Artificial Sequence: Synthetic oligonucleotide
gacgactcccatgggagtcgtcc

SEQ ID NO: 4431 - DNA, 23 bp, Artificial Sequence
  Description of Artificial Sequence: Synthetic oligonucleotide
ggagactcccatgggagtctccc

SEQ ID NO: 4432 - DNA, 23 bp, Artificial Sequence
  Description of Artificial Sequence: Synthetic oligonucleotide
ggcgactcccatgggagtcgcca

SEQ ID NO: 4433 - DNA, 23 bp, Artificial Sequence
  Description of Artificial Sequence: Synthetic oligonucleotide
tgcgactcccatgggagtcgcac

SEQ ID NO: 4434 - DNA, 23 bp, Artificial Sequence
  Description of Artificial Sequence: Synthetic oligonucleotide
ggtgactcccatgggagtcaccc

SEQ ID NO: 4435 - DNA, 23 bp, Artificial Sequence
  Description of Artificial Sequence: Synthetic oligonucleotide
cgggactcccatgggagtcccgt

SEQ ID NO: 4436 - DNA, 23 bp, Artificial Sequence
  Description of Artificial Sequence: Synthetic oligonucleotide
agggactcccatgggagtccctg

SEQ ID NO: 4437 - DNA, 23 bp, Artificial Sequence
  Description of Artificial Sequence: Synthetic oligonucleotide
caggactcccatgggagtcctgg

SEQ ID NO: 4438 - DNA, 23 bp, Artificial Sequence
  Description of Artificial Sequence: Synthetic oligonucleotide
cgagactcccatgggagtctcgg

SEQ ID NO: 4439 - DNA, 23 bp, Artificial Sequence
  Description of Artificial Sequence: Synthetic oligonucleotide
cgggactcccatgggagtcccga

SEQ ID NO: 4440 - DNA, 23 bp, Artificial Sequence
  Description of Artificial Sequence: Synthetic oligonucleotide
tgggactcccatgggagtcccag

SEQ ID NO: 4441 - DNA, 23 bp, Artificial Sequence
  Description of Artificial Sequence: Synthetic oligonucleotide
ctggactcccatgggagtccagg

SEQ ID NO: 4442 - DNA, 23 bp, Artificial Sequence
  Description of Artificial Sequence: Synthetic oligonucleotide
cgtgactcccatgggagtcacgg

SEQ ID NO: 4443 - DNA, 23 bp, Artificial Sequence
  Description of Artificial Sequence: Synthetic oligonucleotide
ggcgactcccatgggagtcgccg

SEQ ID NO: 4444 - DNA, 23 bp, Artificial Sequence
  Description of Artificial Sequence: Synthetic oligonucleotide
agcgactcccatgggagtcgctg

SEQ ID NO: 4445 - DNA, 23 bp, Artificial Sequence
  Description of Artificial Sequence: Synthetic oligonucleotide
gacgactcccatgggagtcgtcg

SEQ ID NO: 4446 - DNA, 23 bp, Artificial Sequence
  Description of Artificial Sequence: Synthetic oligonucleotide
ggagactcccatgggagtctccg

SEQ ID NO: 4447 - DNA, 23 bp, Artificial Sequence
  Description of Artificial Sequence: Synthetic oligonucleotide
tgcgactcccatgggagtcgcag

SEQ ID NO: 4448 - DNA, 23 bp, Artificial Sequence
  Description of Artificial Sequence: Synthetic oligonucleotide
ggtgactcccatgggagtcaccg

SEQ ID NO: 4449 - DNA, 23 bp, Artificial Sequence
  Description of Artificial Sequence: Synthetic oligonucleotide
acggactcccatgggagtccgtg

SEQ ID NO: 4450 - DNA, 23 bp, Artificial Sequence
  Description of Artificial Sequence: Synthetic oligonucleotide
ccagactcccatgggagtctggg

SEQ ID NO: 4451 - DNA, 23 bp, Artificial Sequence
  Description of Artificial Sequence: Synthetic oligonucleotide
tcggactcccatgggagtccgag

SEQ ID NO: 4452 - DNA, 23 bp, Artificial Sequence
  Description of Artificial Sequence: Synthetic oligonucleotide
cctgactcccatgggagtcaggg

SEQ ID NO: 4453 - DNA, 23 bp, Artificial Sequence
  Description of Artificial Sequence: Synthetic oligonucleotide
cacgactcccatgggagtcgtgg

SEQ ID NO: 4454 - DNA, 23 bp, Artificial Sequence
  Description of Artificial Sequence: Synthetic oligonucleotide
gccgactcccatgggagtcggct

SEQ ID NO: 4455 - DNA, 23 bp, Artificial Sequence
  Description of Artificial Sequence: Synthetic oligonucleotide
gccgactcccatgggagtcggca

SEQ ID NO: 4456 - DNA, 23 bp, Artificial Sequence
  Description of Artificial Sequence: Synthetic oligonucleotide
cgagactcccatgggagtctcgc

SEQ ID NO: 4457 - DNA, 23 bp, Artificial Sequence
  Description of Artificial Sequence: Synthetic oligonucleotide
cgtgactcccatgggagtcacgc

SEQ ID NO: 4458 - DNA, 23 bp, Artificial Sequence
  Description of Artificial Sequence: Synthetic oligonucleotide
caggactcccatgggagtcctgc

SEQ ID NO: 4459 - DNA, 23 bp, Artificial Sequence
  Description of Artificial Sequence: Synthetic oligonucleotide
ctggactcccatgggagtccagc

SEQ ID NO: 4460 - DNA, 23 bp, Artificial Sequence
  Description of Artificial Sequence: Synthetic oligonucleotide
gaggactcccatgggagtcctcg

SEQ ID NO: 4461 - DNA, 23 bp, Artificial Sequence
  Description of Artificial Sequence: Synthetic oligonucleotide
gtggactcccatgggagtccacg

SEQ ID NO: 4462 - DNA, 23 bp, Artificial Sequence
  Description of Artificial Sequence: Synthetic oligonucleotide
accgactcccatgggagtcggtg

SEQ ID NO: 4463 - DNA, 23 bp, Artificial Sequence
  Description of Artificial Sequence: Synthetic oligonucleotide
tccgactcccatgggagtcggag

SEQ ID NO: 4464 - DNA, 23 bp, Artificial Sequence
  Description of Artificial Sequence: Synthetic oligonucleotide
cgggactcccatgggagtcccgc

SEQ ID NO: 4465 - DNA, 23 bp, Artificial Sequence
  Description of Artificial Sequence: Synthetic oligonucleotide
agggactcccatgggagtccctc

SEQ ID NO: 4466 - DNA, 23 bp, Artificial Sequence
  Description of Artificial Sequence: Synthetic oligonucleotide
tgggactcccatgggagtcccac

SEQ ID NO: 4467 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccctagggagtcnnnn

SEQ ID NO: 4468 - DNA, 23 bp, Artificial Sequence
  Description of Artificial Sequence: Synthetic oligonucleotide
gcggactccctagggagtccgcc

SEQ ID NO: 4469 - DNA, 23 bp, Artificial Sequence
  Description of Artificial Sequence: Synthetic oligonucleotide
gcggactccctagggagtccgct

SEQ ID NO: 4470 - DNA, 23 bp, Artificial Sequence
  Description of Artificial Sequence: Synthetic oligonucleotide
acggactccctagggagtccgtc

SEQ ID NO: 4471 - DNA, 23 bp, Artificial Sequence
  Description of Artificial Sequence: Synthetic oligonucleotide
gaggactccctagggagtcctcc

SEQ ID NO: 4472 - DNA, 23 bp, Artificial Sequence
  Description of Artificial Sequence: Synthetic oligonucleotide
gcagactccctagggagtctgcc

SEQ ID NO: 4473 - DNA, 23 bp, Artificial Sequence
  Description of Artificial Sequence: Synthetic oligonucleotide
gcggactccctagggagtccgca

SEQ ID NO: 4474 - DNA, 23 bp, Artificial Sequence
  Description of Artificial Sequence: Synthetic oligonucleotide
tcggactccctagggagtccgac

SEQ ID NO: 4475 - DNA, 23 bp, Artificial Sequence
  Description of Artificial Sequence: Synthetic oligonucleotide
gtggactccctagggagtccacc

SEQ ID NO: 4476 - DNA, 23 bp, Artificial Sequence
  Description of Artificial Sequence: Synthetic oligonucleotide
gctgactccctagggagtcagcc

SEQ ID NO: 4477 - DNA, 23 bp, Artificial Sequence
  Description of Artificial Sequence: Synthetic oligonucleotide
cccgactccctagggagtcgggc

SEQ ID NO: 4478 - DNA, 23 bp, Artificial Sequence
  Description of Artificial Sequence: Synthetic oligonucleotide
cccgactccctagggagtcgggt

SEQ ID NO: 4479 - DNA, 23 bp, Artificial Sequence
  Description of Artificial Sequence: Synthetic oligonucleotide
accgactccctagggagtcggtc

SEQ ID NO: 4480 - DNA, 23 bp, Artificial Sequence
  Description of Artificial Sequence: Synthetic oligonucleotide
cacgactccctagggagtcgtgc

SEQ ID NO: 4481 - DNA, 23 bp, Artificial Sequence
  Description of Artificial Sequence: Synthetic oligonucleotide
ccagactccctagggagtctggc

SEQ ID NO: 4482 - DNA, 23 bp, Artificial Sequence
  Description of Artificial Sequence: Synthetic oligonucleotide
cccgactccctagggagtcggga

SEQ ID NO: 4483 - DNA, 23 bp, Artificial Sequence
  Description of Artificial Sequence: Synthetic oligonucleotide
tccgactccctagggagtcggac

SEQ ID NO: 4484 - DNA, 23 bp, Artificial Sequence
  Description of Artificial Sequence: Synthetic oligonucleotide
cctgactccctagggagtcaggc

SEQ ID NO: 4485 - DNA, 23 bp, Artificial Sequence
  Description of Artificial Sequence: Synthetic oligonucleotide
ggcgactccctagggagtcgccc

SEQ ID NO: 4486 - DNA, 23 bp, Artificial Sequence
  Description of Artificial Sequence: Synthetic oligonucleotide
ggcgactccctagggagtcgcct

SEQ ID NO: 4487 - DNA, 23 bp, Artificial Sequence
  Description of Artificial Sequence: Synthetic oligonucleotide
agcgactccctagggagtcgctc

SEQ ID NO: 4488 - DNA, 23 bp, Artificial Sequence
  Description of Artificial Sequence: Synthetic oligonucleotide
gacgactccctagggagtcgtcc

SEQ ID NO: 4489 - DNA, 23 bp, Artificial Sequence
  Description of Artificial Sequence: Synthetic oligonucleotide
ggagactccctagggagtctccc

SEQ ID NO: 4490 - DNA, 23 bp, Artificial Sequence
  Description of Artificial Sequence: Synthetic oligonucleotide
ggcgactccctagggagtcgcca

SEQ ID NO: 4491 - DNA, 23 bp, Artificial Sequence
  Description of Artificial Sequence: Synthetic oligonucleotide
tgcgactccctagggagtcgcac

SEQ ID NO: 4492 - DNA, 23 bp, Artificial Sequence
  Description of Artificial Sequence: Synthetic oligonucleotide
ggtgactccctagggagtcaccc

SEQ ID NO: 4493 - DNA, 23 bp, Artificial Sequence
  Description of Artificial Sequence: Synthetic oligonucleotide
cgggactccctagggagtcccgt

SEQ ID NO: 4494 - DNA, 23 bp, Artificial Sequence
  Description of Artificial Sequence: Synthetic oligonucleotide
agggactccctagggagtccctg

SEQ ID NO: 4495 - DNA, 23 bp, Artificial Sequence
  Description of Artificial Sequence: Synthetic oligonucleotide
caggactccctagggagtcctgg

SEQ ID NO: 4496 - DNA, 23 bp, Artificial Sequence
  Description of Artificial Sequence: Synthetic oligonucleotide
cgagactccctagggagtctcgg

SEQ ID NO: 4497 - DNA, 23 bp, Artificial Sequence
  Description of Artificial Sequence: Synthetic oligonucleotide
cgggactccctagggagtcccga

SEQ ID NO: 4498 - DNA, 23 bp, Artificial Sequence
  Description of Artificial Sequence: Synthetic oligonucleotide
tgggactccctagggagtcccag

SEQ ID NO: 4499 - DNA, 23 bp, Artificial Sequence
  Description of Artificial Sequence: Synthetic oligonucleotide
ctggactccctagggagtccagg

SEQ ID NO: 4500 - DNA, 23 bp, Artificial Sequence
  Description of Artificial Sequence: Synthetic oligonucleotide
cgtgactccctagggagtcacgg

SEQ ID NO: 4501 - DNA, 23 bp, Artificial Sequence
  Description of Artificial Sequence: Synthetic oligonucleotide
ggcgactccctagggagtcgccg

SEQ ID NO: 4502 - DNA, 23 bp, Artificial Sequence
  Description of Artificial Sequence: Synthetic oligonucleotide
agcgactccctagggagtcgctg

SEQ ID NO: 4503 - DNA, 23 bp, Artificial Sequence
  Description of Artificial Sequence: Synthetic oligonucleotide
gacgactccctagggagtcgtcg

SEQ ID NO: 4504 - DNA, 23 bp, Artificial Sequence
  Description of Artificial Sequence: Synthetic oligonucleotide
ggagactccctagggagtctccg

SEQ ID NO: 4505 - DNA, 23 bp, Artificial Sequence
  Description of Artificial Sequence: Synthetic oligonucleotide
tgcgactccctagggagtcgcag

SEQ ID NO: 4506 - DNA, 23 bp, Artificial Sequence
  Description of Artificial Sequence: Synthetic oligonucleotide
ggtgactccctagggagtcaccg

SEQ ID NO: 4507 - DNA, 23 bp, Artificial Sequence
  Description of Artificial Sequence: Synthetic oligonucleotide
acggactccctagggagtccgtg

SEQ ID NO: 4508 - DNA, 23 bp, Artificial Sequence
  Description of Artificial Sequence: Synthetic oligonucleotide
ccagactccctagggagtctggg

SEQ ID NO: 4509 - DNA, 23 bp, Artificial Sequence
  Description of Artificial Sequence: Synthetic oligonucleotide
tcggactccctagggagtccgag

SEQ ID NO: 4510 - DNA, 23 bp, Artificial Sequence
  Description of Artificial Sequence: Synthetic oligonucleotide
cctgactccctagggagtcaggg

SEQ ID NO: 4511 - DNA, 23 bp, Artificial Sequence
  Description of Artificial Sequence: Synthetic oligonucleotide
cacgactccctagggagtcgtgg

SEQ ID NO: 4512 - DNA, 23 bp, Artificial Sequence
  Description of Artificial Sequence: Synthetic oligonucleotide
gccgactccctagggagtcggct

SEQ ID NO: 4513 - DNA, 23 bp, Artificial Sequence
  Description of Artificial Sequence: Synthetic oligonucleotide
gccgactccctagggagtcggca

SEQ ID NO: 4514 - DNA, 23 bp, Artificial Sequence
  Description of Artificial Sequence: Synthetic oligonucleotide
cgagactccctagggagtctcgc

SEQ ID NO: 4515 - DNA, 23 bp, Artificial Sequence
  Description of Artificial Sequence: Synthetic oligonucleotide
cgtgactccctagggagtcacgc

SEQ ID NO: 4516 - DNA, 23 bp, Artificial Sequence
  Description of Artificial Sequence: Synthetic oligonucleotide
caggactccctagggagtcctgc

SEQ ID NO: 4517 - DNA, 23 bp, Artificial Sequence
  Description of Artificial Sequence: Synthetic oligonucleotide
ctggactccctagggagtccagc

SEQ ID NO: 4518 - DNA, 23 bp, Artificial Sequence
  Description of Artificial Sequence: Synthetic oligonucleotide
gaggactccctagggagtcctcg

SEQ ID NO: 4519 - DNA, 23 bp, Artificial Sequence
  Description of Artificial Sequence: Synthetic oligonucleotide
gtggactccctagggagtccacg

SEQ ID NO: 4520 - DNA, 23 bp, Artificial Sequence
  Description of Artificial Sequence: Synthetic oligonucleotide
accgactccctagggagtcggtg

SEQ ID NO: 4521 - DNA, 23 bp, Artificial Sequence
  Description of Artificial Sequence: Synthetic oligonucleotide
tccgactccctagggagtcggag

SEQ ID NO: 4522 - DNA, 23 bp, Artificial Sequence
  Description of Artificial Sequence: Synthetic oligonucleotide
cgggactccctagggagtcccgc

SEQ ID NO: 4523 - DNA, 23 bp, Artificial Sequence
  Description of Artificial Sequence: Synthetic oligonucleotide
agggactccctagggagtccctc

SEQ ID NO: 4524 - DNA, 23 bp, Artificial Sequence
  Description of Artificial Sequence: Synthetic oligonucleotide
tgggactccctagggagtcccac

SEQ ID NO: 4525 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcccgcgggagtcnnnn

SEQ ID NO: 4526 - DNA, 23 bp, Artificial Sequence
  Description of Artificial Sequence: Synthetic oligonucleotide
gcggactcccgcgggagtccgcc

SEQ ID NO: 4527 - DNA, 23 bp, Artificial Sequence
  Description of Artificial Sequence: Synthetic oligonucleotide
gcggactcccgcgggagtccgct

SEQ ID NO: 4528 - DNA, 23 bp, Artificial Sequence
  Description of Artificial Sequence: Synthetic oligonucleotide
acggactcccgcgggagtccgtc

SEQ ID NO: 4529 - DNA, 23 bp, Artificial Sequence
  Description of Artificial Sequence: Synthetic oligonucleotide
gaggactcccgcgggagtcctcc

SEQ ID NO: 4530 - DNA, 23 bp, Artificial Sequence
  Description of Artificial Sequence: Synthetic oligonucleotide
gcagactcccgcgggagtctgcc

SEQ ID NO: 4531 - DNA, 23 bp, Artificial Sequence
  Description of Artificial Sequence: Synthetic oligonucleotide
gcggactcccgcgggagtccgca

SEQ ID NO: 4532 - DNA, 23 bp, Artificial Sequence
  Description of Artificial Sequence: Synthetic oligonucleotide
tcggactcccgcgggagtccgac

SEQ ID NO: 4533 - DNA, 23 bp, Artificial Sequence
  Description of Artificial Sequence: Synthetic oligonucleotide
gtggactcccgcgggagtccacc

SEQ ID NO: 4534 - DNA, 23 bp, Artificial Sequence
  Description of Artificial Sequence: Synthetic oligonucleotide
gctgactcccgcgggagtcagcc

SEQ ID NO: 4535 - DNA, 23 bp, Artificial Sequence
  Description of Artificial Sequence: Synthetic oligonucleotide
cccgactcccgcgggagtcgggc

SEQ ID NO: 4536 - DNA, 23 bp, Artificial Sequence
  Description of Artificial Sequence: Synthetic oligonucleotide
cccgactcccgcgggagtcgggt

SEQ ID NO: 4537 - DNA, 23 bp, Artificial Sequence
  Description of Artificial Sequence: Synthetic oligonucleotide
accgactcccgcgggagtcggtc

SEQ ID NO: 4538 - DNA, 23 bp, Artificial Sequence
  Description of Artificial Sequence: Synthetic oligonucleotide
cacgactcccgcgggagtcgtgc

SEQ ID NO: 4539 - DNA, 23 bp, Artificial Sequence
  Description of Artificial Sequence: Synthetic oligonucleotide
ccagactcccgcgggagtctggc

SEQ ID NO: 4540 - DNA, 23 bp, Artificial Sequence
  Description of Artificial Sequence: Synthetic oligonucleotide
cccgactcccgcgggagtcggga

SEQ ID NO: 4541 - DNA, 23 bp, Artificial Sequence
  Description of Artificial Sequence: Synthetic oligonucleotide
tccgactcccgcgggagtcggac

SEQ ID NO: 4542 - DNA, 23 bp, Artificial Sequence
  Description of Artificial Sequence: Synthetic oligonucleotide
cctgactcccgcgggagtcaggc

SEQ ID NO: 4543 - DNA, 23 bp, Artificial Sequence
  Description of Artificial Sequence: Synthetic oligonucleotide
ggcgactcccgcgggagtcgccc

SEQ ID NO: 4544 - DNA, 23 bp, Artificial Sequence
  Description of Artificial Sequence: Synthetic oligonucleotide
ggcgactcccgcgggagtcgcct

SEQ ID NO: 4545 - DNA, 23 bp, Artificial Sequence
  Description of Artificial Sequence: Synthetic oligonucleotide
agcgactcccgcgggagtcgctc

SEQ ID NO: 4546 - DNA, 23 bp, Artificial Sequence
  Description of Artificial Sequence: Synthetic oligonucleotide
gacgactcccgcgggagtcgtcc

SEQ ID NO: 4547 - DNA, 23 bp, Artificial Sequence
  Description of Artificial Sequence: Synthetic oligonucleotide
ggagactcccgcgggagtctccc

SEQ ID NO: 4548 - DNA, 23 bp, Artificial Sequence
  Description of Artificial Sequence: Synthetic oligonucleotide
ggcgactcccgcgggagtcgcca

SEQ ID NO: 4549 - DNA, 23 bp, Artificial Sequence
  Description of Artificial Sequence: Synthetic oligonucleotide
tgcgactcccgcgggagtcgcac

SEQ ID NO: 4550 - DNA, 23 bp, Artificial Sequence
  Description of Artificial Sequence: Synthetic oligonucleotide
ggtgactcccgcgggagtcaccc

SEQ ID NO: 4551 - DNA, 23 bp, Artificial Sequence
  Description of Artificial Sequence: Synthetic oligonucleotide
cgggactcccgcgggagtcccgt

SEQ ID NO: 4552 - DNA, 23 bp, Artificial Sequence
  Description of Artificial Sequence: Synthetic oligonucleotide
agggactcccgcgggagtccctg

SEQ ID NO: 4553 - DNA, 23 bp, Artificial Sequence
  Description of Artificial Sequence: Synthetic oligonucleotide
caggactcccgcgggagtcctgg

SEQ ID NO: 4554 - DNA, 23 bp, Artificial Sequence
  Description of Artificial Sequence: Synthetic oligonucleotide
cgagactcccgcgggagtctcgg

SEQ ID NO: 4555 - DNA, 23 bp, Artificial Sequence
  Description of Artificial Sequence: Synthetic oligonucleotide
cgggactcccgcgggagtcccga

SEQ ID NO: 4556 - DNA, 23 bp, Artificial Sequence
  Description of Artificial Sequence: Synthetic oligonucleotide
tgggactcccgcgggagtcccag

SEQ ID NO: 4557 - DNA, 23 bp, Artificial Sequence
  Description of Artificial Sequence: Synthetic oligonucleotide
ctggactcccgcgggagtccagg

SEQ ID NO: 4558 - DNA, 23 bp, Artificial Sequence
  Description of Artificial Sequence: Synthetic oligonucleotide
cgtgactcccgcgggagtcacgg

SEQ ID NO: 4559 - DNA, 23 bp, Artificial Sequence
  Description of Artificial Sequence: Synthetic oligonucleotide
ggcgactcccgcgggagtcgccg

SEQ ID NO: 4560 - DNA, 23 bp, Artificial Sequence
  Description of Artificial Sequence: Synthetic oligonucleotide
agcgactcccgcgggagtcgctg

SEQ ID NO: 4561 - DNA, 23 bp, Artificial Sequence
  Description of Artificial Sequence: Synthetic oligonucleotide
gacgactcccgcgggagtcgtcg

SEQ ID NO: 4562 - DNA, 23 bp, Artificial Sequence
  Description of Artificial Sequence: Synthetic oligonucleotide
ggagactcccgcgggagtctccg

SEQ ID NO: 4563 - DNA, 23 bp, Artificial Sequence
  Description of Artificial Sequence: Synthetic oligonucleotide
tgcgactcccgcgggagtcgcag

SEQ ID NO: 4564 - DNA, 23 bp, Artificial Sequence
  Description of Artificial Sequence: Synthetic oligonucleotide
ggtgactcccgcgggagtcaccg

SEQ ID NO: 4565 - DNA, 23 bp, Artificial Sequence
  Description of Artificial Sequence: Synthetic oligonucleotide
acggactcccgcgggagtccgtg

SEQ ID NO: 4566 - DNA, 23 bp, Artificial Sequence
  Description of Artificial Sequence: Synthetic oligonucleotide
ccagactcccgcgggagtctggg

SEQ ID NO: 4567 - DNA, 23 bp, Artificial Sequence
  Description of Artificial Sequence: Synthetic oligonucleotide
tcggactcccgcgggagtccgag

SEQ ID NO: 4568 - DNA, 23 bp, Artificial Sequence
  Description of Artificial Sequence: Synthetic oligonucleotide
cctgactcccgcgggagtcaggg

SEQ ID NO: 4569 - DNA, 23 bp, Artificial Sequence
  Description of Artificial Sequence: Synthetic oligonucleotide
cacgactcccgcgggagtcgtgg

SEQ ID NO: 4570 - DNA, 23 bp, Artificial Sequence
  Description of Artificial Sequence: Synthetic oligonucleotide
gccgactcccgcgggagtcggct

SEQ ID NO: 4571 - DNA, 23 bp, Artificial Sequence
  Description of Artificial Sequence: Synthetic oligonucleotide
gccgactcccgcgggagtcggca

SEQ ID NO: 4572 - DNA, 23 bp, Artificial Sequence
  Description of Artificial Sequence: Synthetic oligonucleotide
cgagactcccgcgggagtctcgc

SEQ ID NO: 4573 - DNA, 23 bp, Artificial Sequence
  Description of Artificial Sequence: Synthetic oligonucleotide
cgtgactcccgcgggagtcacgc

SEQ ID NO: 4574 - DNA, 23 bp, Artificial Sequence
  Description of Artificial Sequence: Synthetic oligonucleotide
caggactcccgcgggagtcctgc

SEQ ID NO: 4575 - DNA, 23 bp, Artificial Sequence
  Description of Artificial Sequence: Synthetic oligonucleotide
ctggactcccgcgggagtccagc

SEQ ID NO: 4576 - DNA, 23 bp, Artificial Sequence
  Description of Artificial Sequence: Synthetic oligonucleotide
gaggactcccgcgggagtcctcg

SEQ ID NO: 4577 - DNA, 23 bp, Artificial Sequence
  Description of Artificial Sequence: Synthetic oligonucleotide
gtggactcccgcgggagtccacg

SEQ ID NO: 4578 - DNA, 23 bp, Artificial Sequence
  Description of Artificial Sequence: Synthetic oligonucleotide
accgactcccgcgggagtcggtg

SEQ ID NO: 4579 - DNA, 23 bp, Artificial Sequence
  Description of Artificial Sequence: Synthetic oligonucleotide
tccgactcccgcgggagtcggag

SEQ ID NO: 4580 - DNA, 23 bp, Artificial Sequence
  Description of Artificial Sequence: Synthetic oligonucleotide
cgggactcccgcgggagtcccgc

SEQ ID NO: 4581 - DNA, 23 bp, Artificial Sequence
  Description of Artificial Sequence: Synthetic oligonucleotide
agggactcccgcgggagtccctc

SEQ ID NO: 4582 - DNA, 23 bp, Artificial Sequence
  Description of Artificial Sequence: Synthetic oligonucleotide
tgggactcccgcgggagtcccac

SEQ ID NO: 4583 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccccggggagtcnnnn

SEQ ID NO: 4584 - DNA, 23 bp, Artificial Sequence
  Description of Artificial Sequence: Synthetic oligonucleotide
gcggactccccggggagtccgcc

SEQ ID NO: 4585 - DNA, 23 bp, Artificial Sequence
  Description of Artificial Sequence: Synthetic oligonucleotide
gcggactccccggggagtccgct

SEQ ID NO: 4586 - DNA, 23 bp, Artificial Sequence
  Description of Artificial Sequence: Synthetic oligonucleotide
acggactccccggggagtccgtc

SEQ ID NO: 4587 - DNA, 23 bp, Artificial Sequence
  Description of Artificial Sequence: Synthetic oligonucleotide
gaggactccccggggagtcctcc

SEQ ID NO: 4588 - DNA, 23 bp, Artificial Sequence
  Description of Artificial Sequence: Synthetic oligonucleotide
gcagactccccggggagtctgcc

SEQ ID NO: 4589 - DNA, 23 bp, Artificial Sequence
  Description of Artificial Sequence: Synthetic oligonucleotide
gcggactccccggggagtccgca

SEQ ID NO: 4590 - DNA, 23 bp, Artificial Sequence
  Description of Artificial Sequence: Synthetic oligonucleotide
tcggactccccggggagtccgac

SEQ ID NO: 4591 - DNA, 23 bp, Artificial Sequence
  Description of Artificial Sequence: Synthetic oligonucleotide
gtggactccccggggagtccacc

SEQ ID NO: 4592 - DNA, 23 bp, Artificial Sequence
  Description of Artificial Sequence: Synthetic oligonucleotide
gctgactccccggggagtcagcc

SEQ ID NO: 4593 - DNA, 23 bp, Artificial Sequence
  Description of Artificial Sequence: Synthetic oligonucleotide
cccgactccccggggagtcgggc

SEQ ID NO: 4594 - DNA, 23 bp, Artificial Sequence
  Description of Artificial Sequence: Synthetic oligonucleotide
cccgactccccggggagtcgggt

SEQ ID NO: 4595 - DNA, 23 bp, Artificial Sequence
  Description of Artificial Sequence: Synthetic oligonucleotide
accgactccccggggagtcggtc

SEQ ID NO: 4596 - DNA, 23 bp, Artificial Sequence
  Description of Artificial Sequence: Synthetic oligonucleotide
cacgactccccggggagtcgtgc

SEQ ID NO: 4597 - DNA, 23 bp, Artificial Sequence
  Description of Artificial Sequence: Synthetic oligonucleotide
ccagactccccggggagtctggc

SEQ ID NO: 4598 - DNA, 23 bp, Artificial Sequence
  Description of Artificial Sequence: Synthetic oligonucleotide
cccgactccccggggagtcggga

SEQ ID NO: 4599 - DNA, 23 bp, Artificial Sequence
  Description of Artificial Sequence: Synthetic oligonucleotide
tccgactccccggggagtcggac

SEQ ID NO: 4600 - DNA, 23 bp, Artificial Sequence
  Description of Artificial Sequence: Synthetic oligonucleotide
cctgactccccggggagtcaggc

SEQ ID NO: 4601 - DNA, 23 bp, Artificial Sequence
  Description of Artificial Sequence: Synthetic oligonucleotide
ggcgactccccggggagtcgccc

SEQ ID NO: 4602 - DNA, 23 bp, Artificial Sequence
  Description of Artificial Sequence: Synthetic oligonucleotide
ggcgactccccggggagtcgcct

SEQ ID NO: 4603 - DNA, 23 bp, Artificial Sequence
  Description of Artificial Sequence: Synthetic oligonucleotide
agcgactccccggggagtcgctc

SEQ ID NO: 4604 - DNA, 23 bp, Artificial Sequence
  Description of Artificial Sequence: Synthetic oligonucleotide
gacgactccccggggagtcgtcc

SEQ ID NO: 4605 - DNA, 23 bp, Artificial Sequence
  Description of Artificial Sequence: Synthetic oligonucleotide
ggagactccccggggagtctccc

SEQ ID NO: 4606 - DNA, 23 bp, Artificial Sequence
  Description of Artificial Sequence: Synthetic oligonucleotide
ggcgactccccggggagtcgcca

SEQ ID NO: 4607 - DNA, 23 bp, Artificial Sequence
  Description of Artificial Sequence: Synthetic oligonucleotide
tgcgactccccggggagtcgcac

SEQ ID NO: 4608 - DNA, 23 bp, Artificial Sequence
  Description of Artificial Sequence: Synthetic oligonucleotide
ggtgactccccggggagtcaccc

SEQ ID NO: 4609 - DNA, 23 bp, Artificial Sequence
  Description of Artificial Sequence: Synthetic oligonucleotide
cgggactccccggggagtcccgt

SEQ ID NO: 4610 - DNA, 23 bp, Artificial Sequence
  Description of Artificial Sequence: Synthetic oligonucleotide
agggactccccggggagtccctg

SEQ ID NO: 4611 - DNA, 23 bp, Artificial Sequence
  Description of Artificial Sequence: Synthetic oligonucleotide
caggactccccggggagtcctgg

SEQ ID NO: 4612 - DNA, 23 bp, Artificial Sequence
  Description of Artificial Sequence: Synthetic oligonucleotide
cgagactccccggggagtctcgg

SEQ ID NO: 4613 - DNA, 23 bp, Artificial Sequence
  Description of Artificial Sequence: Synthetic oligonucleotide
cgggactccccggggagtcccga

SEQ ID NO: 4614 - DNA, 23 bp, Artificial Sequence
  Description of Artificial Sequence: Synthetic oligonucleotide
tgggactccccggggagtcccag

SEQ ID NO: 4615 - DNA, 23 bp, Artificial Sequence
  Description of Artificial Sequence: Synthetic oligonucleotide
ctggactccccggggagtccagg

SEQ ID NO: 4616 - DNA, 23 bp, Artificial Sequence
  Description of Artificial Sequence: Synthetic oligonucleotide
cgtgactccccggggagtcacgg

SEQ ID NO: 4617 - DNA, 23 bp, Artificial Sequence
  Description of Artificial Sequence: Synthetic oligonucleotide
ggcgactccccggggagtcgccg

SEQ ID NO: 4618 - DNA, 23 bp, Artificial Sequence
  Description of Artificial Sequence: Synthetic oligonucleotide
agcgactccccggggagtcgctg

SEQ ID NO: 4619 - DNA, 23 bp, Artificial Sequence
  Description of Artificial Sequence: Synthetic oligonucleotide
gacgactccccggggagtcgtcg

SEQ ID NO: 4620 - DNA, 23 bp, Artificial Sequence
  Description of Artificial Sequence: Synthetic oligonucleotide
ggagactccccggggagtctccg

SEQ ID NO: 4621 - DNA, 23 bp, Artificial Sequence
  Description of Artificial Sequence: Synthetic oligonucleotide
tgcgactccccggggagtcgcag

SEQ ID NO: 4622 - DNA, 23 bp, Artificial Sequence
  Description of Artificial Sequence: Synthetic oligonucleotide
ggtgactccccggggagtcaccg

SEQ ID NO: 4623 - DNA, 23 bp, Artificial Sequence
  Description of Artificial Sequence: Synthetic oligonucleotide
acggactccccggggagtccgtg

SEQ ID NO: 4624 - DNA, 23 bp, Artificial Sequence
  Description of Artificial Sequence: Synthetic oligonucleotide
ccagactccccggggagtctggg

SEQ ID NO: 4625 - DNA, 23 bp, Artificial Sequence
  Description of Artificial Sequence: Synthetic oligonucleotide
tcggactccccggggagtccgag

SEQ ID NO: 4626 - DNA, 23 bp, Artificial Sequence
  Description of Artificial Sequence: Synthetic oligonucleotide
cctgactccccggggagtcaggg

SEQ ID NO: 4627 - DNA, 23 bp, Artificial Sequence
  Description of Artificial Sequence: Synthetic oligonucleotide
cacgactccccggggagtcgtgg

SEQ ID NO: 4628 - DNA, 23 bp, Artificial Sequence
  Description of Artificial Sequence: Synthetic oligonucleotide
gccgactccccggggagtcggct

SEQ ID NO: 4629 - DNA, 23 bp, Artificial Sequence
  Description of Artificial Sequence: Synthetic oligonucleotide
gccgactccccggggagtcggca

SEQ ID NO: 4630 - DNA, 23 bp, Artificial Sequence
  Description of Artificial Sequence: Synthetic oligonucleotide
cgagactccccggggagtctcgc

SEQ ID NO: 4631 - DNA, 23 bp, Artificial Sequence
  Description of Artificial Sequence: Synthetic oligonucleotide
cgtgactccccggggagtcacgc

SEQ ID NO: 4632 - DNA, 23 bp, Artificial Sequence
  Description of Artificial Sequence: Synthetic oligonucleotide
caggactccccggggagtcctgc

SEQ ID NO: 4633 - DNA, 23 bp, Artificial Sequence
  Description of Artificial Sequence: Synthetic oligonucleotide
ctggactccccggggagtccagc

SEQ ID NO: 4634 - DNA, 23 bp, Artificial Sequence
  Description of Artificial Sequence: Synthetic oligonucleotide
gaggactccccggggagtcctcg

SEQ ID NO: 4635 - DNA, 23 bp, Artificial Sequence
  Description of Artificial Sequence: Synthetic oligonucleotide
gtggactccccggggagtccacg

SEQ ID NO: 4636 - DNA, 23 bp, Artificial Sequence
  Description of Artificial Sequence: Synthetic oligonucleotide
accgactccccggggagtcggtg

SEQ ID NO: 4637 - DNA, 23 bp, Artificial Sequence
  Description of Artificial Sequence: Synthetic oligonucleotide
tccgactccccggggagtcggag

SEQ ID NO: 4638 - DNA, 23 bp, Artificial Sequence
  Description of Artificial Sequence: Synthetic oligonucleotide
cgggactccccggggagtcccgc

SEQ ID NO: 4639 - DNA, 23 bp, Artificial Sequence
  Description of Artificial Sequence: Synthetic oligonucleotide
agggactccccggggagtccctc

SEQ ID NO: 4640 - DNA, 23 bp, Artificial Sequence
  Description of Artificial Sequence: Synthetic oligonucleotide
tgggactccccggggagtcccac

SEQ ID NO: 4641 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgtatacgagtcnnnn

SEQ ID NO: 4642 - DNA, 23 bp, Artificial Sequence
  Description of Artificial Sequence: Synthetic oligonucleotide
gcggactcgtatacgagtccgcc

SEQ ID NO: 4643 - DNA, 23 bp, Artificial Sequence
  Description of Artificial Sequence: Synthetic oligonucleotide
gcggactcgtatacgagtccgct

SEQ ID NO: 4644 - DNA, 23 bp, Artificial Sequence
  Description of Artificial Sequence: Synthetic oligonucleotide
acggactcgtatacgagtccgtc

SEQ ID NO: 4645 - DNA, 23 bp, Artificial Sequence
  Description of Artificial Sequence: Synthetic oligonucleotide
gaggactcgtatacgagtcctcc

SEQ ID NO: 4646 - DNA, 23 bp, Artificial Sequence
  Description of Artificial Sequence: Synthetic oligonucleotide
gcagactcgtatacgagtctgcc

SEQ ID NO: 4647 - DNA, 23 bp, Artificial Sequence
  Description of Artificial Sequence: Synthetic oligonucleotide
gcggactcgtatacgagtccgca

SEQ ID NO: 4648 - DNA, 23 bp, Artificial Sequence
  Description of Artificial Sequence: Synthetic oligonucleotide
tcggactcgtatacgagtccgac

SEQ ID NO: 4649 - DNA, 23 bp, Artificial Sequence
  Description of Artificial Sequence: Synthetic oligonucleotide
gtggactcgtatacgagtccacc

SEQ ID NO: 4650 - DNA, 23 bp, Artificial Sequence
  Description of Artificial Sequence: Synthetic oligonucleotide
gctgactcgtatacgagtcagcc

SEQ ID NO: 4651 - DNA, 23 bp, Artificial Sequence
  Description of Artificial Sequence: Synthetic oligonucleotide
cccgactcgtatacgagtcgggc

SEQ ID NO: 4652 - DNA, 23 bp, Artificial Sequence
  Description of Artificial Sequence: Synthetic oligonucleotide
cccgactcgtatacgagtcgggt

SEQ ID NO: 4653 - DNA, 23 bp, Artificial Sequence
  Description of Artificial Sequence: Synthetic oligonucleotide
accgactcgtatacgagtcggtc

SEQ ID NO: 4654 - DNA, 23 bp, Artificial Sequence
  Description of Artificial Sequence: Synthetic oligonucleotide
cacgactcgtatacgagtcgtgc

SEQ ID NO: 4655 - DNA, 23 bp, Artificial Sequence
  Description of Artificial Sequence: Synthetic oligonucleotide
ccagactcgtatacgagtctggc

SEQ ID NO: 4656 - DNA, 23 bp, Artificial Sequence
  Description of Artificial Sequence: Synthetic oligonucleotide
cccgactcgtatacgagtcggga

SEQ ID NO: 4657 - DNA, 23 bp, Artificial Sequence
  Description of Artificial Sequence: Synthetic oligonucleotide
tccgactcgtatacgagtcggac

SEQ ID NO: 4658 - DNA, 23 bp, Artificial Sequence
  Description of Artificial Sequence: Synthetic oligonucleotide
cctgactcgtatacgagtcaggc

SEQ ID NO: 4659 - DNA, 23 bp, Artificial Sequence
  Description of Artificial Sequence: Synthetic oligonucleotide
ggcgactcgtatacgagtcgccc

SEQ ID NO: 4660 - DNA, 23 bp, Artificial Sequence
  Description of Artificial Sequence: Synthetic oligonucleotide
ggcgactcgtatacgagtcgcct

SEQ ID NO: 4661 - DNA, 23 bp, Artificial Sequence
  Description of Artificial Sequence: Synthetic oligonucleotide
agcgactcgtatacgagtcgctc

SEQ ID NO: 4662 - DNA, 23 bp, Artificial Sequence
  Description of Artificial Sequence: Synthetic oligonucleotide
gacgactcgtatacgagtcgtcc

SEQ ID NO: 4663 - DNA, 23 bp, Artificial Sequence
  Description of Artificial Sequence: Synthetic oligonucleotide
ggagactcgtatacgagtctccc

SEQ ID NO: 4664 - DNA, 23 bp, Artificial Sequence
  Description of Artificial Sequence: Synthetic oligonucleotide
ggcgactcgtatacgagtcgcca

SEQ ID NO: 4665 - DNA, 23 bp, Artificial Sequence
  Description of Artificial Sequence: Synthetic oligonucleotide
tgcgactcgtatacgagtcgcac

SEQ ID NO: 4666 - DNA, 23 bp, Artificial Sequence
  Description of Artificial Sequence: Synthetic oligonucleotide
ggtgactcgtatacgagtcaccc

SEQ ID NO: 4667 - DNA, 23 bp, Artificial Sequence
  Description of Artificial Sequence: Synthetic oligonucleotide
cgggactcgtatacgagtcccgt

SEQ ID NO: 4668 - DNA, 23 bp, Artificial Sequence
  Description of Artificial Sequence: Synthetic oligonucleotide
agggactcgtatacgagtccctg

SEQ ID NO: 4669 - DNA, 23 bp, Artificial Sequence
  Description of Artificial Sequence: Synthetic oligonucleotide
caggactcgtatacgagtcctgg

SEQ ID NO: 4670 - DNA, 23 bp, Artificial Sequence
  Description of Artificial Sequence: Synthetic oligonucleotide
cgagactcgtatacgagtctcgg

SEQ ID NO: 4671 - DNA, 23 bp, Artificial Sequence
  Description of Artificial Sequence: Synthetic oligonucleotide
cgggactcgtatacgagtcccga

SEQ ID NO: 4672 - DNA, 23 bp, Artificial Sequence
  Description of Artificial Sequence: Synthetic oligonucleotide
tgggactcgtatacgagtcccag

SEQ ID NO: 4673 - DNA, 23 bp, Artificial Sequence
  Description of Artificial Sequence: Synthetic oligonucleotide
ctggactcgtatacgagtccagg

SEQ ID NO: 4674 - DNA, 23 bp, Artificial Sequence
  Description of Artificial Sequence: Synthetic oligonucleotide
cgtgactcgtatacgagtcacgg

SEQ ID NO: 4675 - DNA, 23 bp, Artificial Sequence
  Description of Artificial Sequence: Synthetic oligonucleotide
ggcgactcgtatacgagtcgccg

SEQ ID NO: 4676 - DNA, 23 bp, Artificial Sequence
  Description of Artificial Sequence: Synthetic oligonucleotide
agcgactcgtatacgagtcgctg

SEQ ID NO: 4677 - DNA, 23 bp, Artificial Sequence
  Description of Artificial Sequence: Synthetic oligonucleotide
gacgactcgtatacgagtcgtcg

SEQ ID NO: 4678 - DNA, 23 bp, Artificial Sequence
  Description of Artificial Sequence: Synthetic oligonucleotide
ggagactcgtatacgagtctccg

SEQ ID NO: 4679 - DNA, 23 bp, Artificial Sequence
  Description of Artificial Sequence: Synthetic oligonucleotide
tgcgactcgtatacgagtcgcag

SEQ ID NO: 4680 - DNA, 23 bp, Artificial Sequence
  Description of Artificial Sequence: Synthetic oligonucleotide
ggtgactcgtatacgagtcaccg

SEQ ID NO: 4681 - DNA, 23 bp, Artificial Sequence
  Description of Artificial Sequence: Synthetic oligonucleotide
acggactcgtatacgagtccgtg

SEQ ID NO: 4682 - DNA, 23 bp, Artificial Sequence
  Description of Artificial Sequence: Synthetic oligonucleotide
ccagactcgtatacgagtctggg

SEQ ID NO: 4683 - DNA, 23 bp, Artificial Sequence
  Description of Artificial Sequence: Synthetic oligonucleotide
tcggactcgtatacgagtccgag

SEQ ID NO: 4684 - DNA, 23 bp, Artificial Sequence
  Description of Artificial Sequence: Synthetic oligonucleotide
cctgactcgtatacgagtcaggg

SEQ ID NO: 4685 - DNA, 23 bp, Artificial Sequence
  Description of Artificial Sequence: Synthetic oligonucleotide
cacgactcgtatacgagtcgtgg

SEQ ID NO: 4686 - DNA, 23 bp, Artificial Sequence
  Description of Artificial Sequence: Synthetic oligonucleotide
gccgactcgtatacgagtcggct

SEQ ID NO: 4687 - DNA, 23 bp, Artificial Sequence
  Description of Artificial Sequence: Synthetic oligonucleotide
gccgactcgtatacgagtcggca

SEQ ID NO: 4688 - DNA, 23 bp, Artificial Sequence
  Description of Artificial Sequence: Synthetic oligonucleotide
cgagactcgtatacgagtctcgc

SEQ ID NO: 4689 - DNA, 23 bp, Artificial Sequence
  Description of Artificial Sequence: Synthetic oligonucleotide
cgtgactcgtatacgagtcacgc

SEQ ID NO: 4690 - DNA, 23 bp, Artificial Sequence
  Description of Artificial Sequence: Synthetic oligonucleotide
caggactcgtatacgagtcctgc

SEQ ID NO: 4691 - DNA, 23 bp, Artificial Sequence
  Description of Artificial Sequence: Synthetic oligonucleotide
ctggactcgtatacgagtccagc

SEQ ID NO: 4692 - DNA, 23 bp, Artificial Sequence
  Description of Artificial Sequence: Synthetic oligonucleotide
gaggactcgtatacgagtcctcg

SEQ ID NO: 4693 - DNA, 23 bp, Artificial Sequence
  Description of Artificial Sequence: Synthetic oligonucleotide
gtggactcgtatacgagtccacg

SEQ ID NO: 4694 - DNA, 23 bp, Artificial Sequence
  Description of Artificial Sequence: Synthetic oligonucleotide
accgactcgtatacgagtcggtg

SEQ ID NO: 4695 - DNA, 23 bp, Artificial Sequence
  Description of Artificial Sequence: Synthetic oligonucleotide
tccgactcgtatacgagtcggag

SEQ ID NO: 4696 - DNA, 23 bp, Artificial Sequence
  Description of Artificial Sequence: Synthetic oligonucleotide
cgggactcgtatacgagtcccgc

SEQ ID NO: 4697 - DNA, 23 bp, Artificial Sequence
  Description of Artificial Sequence: Synthetic oligonucleotide
agggactcgtatacgagtccctc

SEQ ID NO: 4698 - DNA, 23 bp, Artificial Sequence
  Description of Artificial Sequence: Synthetic oligonucleotide
tgggactcgtatacgagtcccac

SEQ ID NO: 4699 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgttaacgagtcnnnn

SEQ ID NO: 4700 - DNA, 23 bp, Artificial Sequence
  Description of Artificial Sequence: Synthetic oligonucleotide
gcggactcgttaacgagtccgcc

SEQ ID NO: 4701 - DNA, 23 bp, Artificial Sequence
  Description of Artificial Sequence: Synthetic oligonucleotide
gcggactcgttaacgagtccgct

SEQ ID NO: 4702 - DNA, 23 bp, Artificial Sequence
  Description of Artificial Sequence: Synthetic oligonucleotide
acggactcgttaacgagtccgtc

SEQ ID NO: 4703 - DNA, 23 bp, Artificial Sequence
  Description of Artificial Sequence: Synthetic oligonucleotide
gaggactcgttaacgagtcctcc

SEQ ID NO: 4704 - DNA, 23 bp, Artificial Sequence
  Description of Artificial Sequence: Synthetic oligonucleotide
gcagactcgttaacgagtctgcc

SEQ ID NO: 4705 - DNA, 23 bp, Artificial Sequence
  Description of Artificial Sequence: Synthetic oligonucleotide
gcggactcgttaacgagtccgca

SEQ ID NO: 4706 - DNA, 23 bp, Artificial Sequence
  Description of Artificial Sequence: Synthetic oligonucleotide
tcggactcgttaacgagtccgac

SEQ ID NO: 4707 - DNA, 23 bp, Artificial Sequence
  Description of Artificial Sequence: Synthetic oligonucleotide
gtggactcgttaacgagtccacc

SEQ ID NO: 4708 - DNA, 23 bp, Artificial Sequence
  Description of Artificial Sequence: Synthetic oligonucleotide
gctgactcgttaacgagtcagcc

SEQ ID NO: 4709 - DNA, 23 bp, Artificial Sequence
  Description of Artificial Sequence: Synthetic oligonucleotide
cccgactcgttaacgagtcgggc

SEQ ID NO: 4710 - DNA, 23 bp, Artificial Sequence
  Description of Artificial Sequence: Synthetic oligonucleotide
cccgactcgttaacgagtcgggt

SEQ ID NO: 4711 - DNA, 23 bp, Artificial Sequence
  Description of Artificial Sequence: Synthetic oligonucleotide
accgactcgttaacgagtcggtc

SEQ ID NO: 4712 - DNA, 23 bp, Artificial Sequence
  Description of Artificial Sequence: Synthetic oligonucleotide
cacgactcgttaacgagtcgtgc

SEQ ID NO: 4713 - DNA, 23 bp, Artificial Sequence
  Description of Artificial Sequence: Synthetic oligonucleotide
ccagactcgttaacgagtctggc

SEQ ID NO: 4714 - DNA, 23 bp, Artificial Sequence
  Description of Artificial Sequence: Synthetic oligonucleotide
cccgactcgttaacgagtcggga

SEQ ID NO: 4715 - DNA, 23 bp, Artificial Sequence
  Description of Artificial Sequence: Synthetic oligonucleotide
tccgactcgttaacgagtcggac

SEQ ID NO: 4716 - DNA, 23 bp, Artificial Sequence
  Description of Artificial Sequence: Synthetic oligonucleotide
cctgactcgttaacgagtcaggc

SEQ ID NO: 4717 - DNA, 23 bp, Artificial Sequence
  Description of Artificial Sequence: Synthetic oligonucleotide
ggcgactcgttaacgagtcgccc

SEQ ID NO: 4718 - DNA, 23 bp, Artificial Sequence
  Description of Artificial Sequence: Synthetic oligonucleotide
ggcgactcgttaacgagtcgcct

SEQ ID NO: 4719 - DNA, 23 bp, Artificial Sequence
  Description of Artificial Sequence: Synthetic oligonucleotide
agcgactcgttaacgagtcgctc

SEQ ID NO: 4720 - DNA, 23 bp, Artificial Sequence
  Description of Artificial Sequence: Synthetic oligonucleotide
gacgactcgttaacgagtcgtcc

SEQ ID NO: 4721 - DNA, 23 bp, Artificial Sequence
  Description of Artificial Sequence: Synthetic oligonucleotide
ggagactcgttaacgagtctccc

SEQ ID NO: 4722 - DNA, 23 bp, Artificial Sequence
  Description of Artificial Sequence: Synthetic oligonucleotide
ggcgactcgttaacgagtcgcca

SEQ ID NO: 4723 - DNA, 23 bp, Artificial Sequence
  Description of Artificial Sequence: Synthetic oligonucleotide
tgcgactcgttaacgagtcgcac

SEQ ID NO: 4724 - DNA, 23 bp, Artificial Sequence
  Description of Artificial Sequence: Synthetic oligonucleotide
ggtgactcgttaacgagtcaccc

SEQ ID NO: 4725 - DNA, 23 bp, Artificial Sequence
  Description of Artificial Sequence: Synthetic oligonucleotide
cgggactcgttaacgagtcccgt

SEQ ID NO: 4726 - DNA, 23 bp, Artificial Sequence
  Description of Artificial Sequence: Synthetic oligonucleotide
agggactcgttaacgagtccctg

SEQ ID NO: 4727 - DNA, 23 bp, Artificial Sequence
  Description of Artificial Sequence: Synthetic oligonucleotide
caggactcgttaacgagtcctgg

SEQ ID NO: 4728 - DNA, 23 bp, Artificial Sequence
  Description of Artificial Sequence: Synthetic oligonucleotide
cgagactcgttaacgagtctcgg

SEQ ID NO: 4729 - DNA, 23 bp, Artificial Sequence
  Description of Artificial Sequence: Synthetic oligonucleotide
cgggactcgttaacgagtcccga

SEQ ID NO: 4730 - DNA, 23 bp, Artificial Sequence
  Description of Artificial Sequence: Synthetic oligonucleotide
tgggactcgttaacgagtcccag

SEQ ID NO: 4731 - DNA, 23 bp, Artificial Sequence
  Description of Artificial Sequence: Synthetic oligonucleotide
ctggactcgttaacgagtccagg

SEQ ID NO: 4732 - DNA, 23 bp, Artificial Sequence
  Description of Artificial Sequence: Synthetic oligonucleotide
cgtgactcgttaacgagtcacgg

SEQ ID NO: 4733 - DNA, 23 bp, Artificial Sequence
  Description of Artificial Sequence: Synthetic oligonucleotide
ggcgactcgttaacgagtcgccg

SEQ ID NO: 4734 - DNA, 23 bp, Artificial Sequence
  Description of Artificial Sequence: Synthetic oligonucleotide
agcgactcgttaacgagtcgctg

SEQ ID NO: 4735 - DNA, 23 bp, Artificial Sequence
  Description of Artificial Sequence: Synthetic oligonucleotide
gacgactcgttaacgagtcgtcg

SEQ ID NO: 4736 - DNA, 23 bp, Artificial Sequence
  Description of Artificial Sequence: Synthetic oligonucleotide
ggagactcgttaacgagtctccg

SEQ ID NO: 4737 - DNA, 23 bp, Artificial Sequence
  Description of Artificial Sequence: Synthetic oligonucleotide
tgcgactcgttaacgagtcgcag

SEQ ID NO: 4738 - DNA, 23 bp, Artificial Sequence
  Description of Artificial Sequence: Synthetic oligonucleotide
ggtgactcgttaacgagtcaccg

SEQ ID NO: 4739 - DNA, 23 bp, Artificial Sequence
  Description of Artificial Sequence: Synthetic oligonucleotide
acggactcgttaacgagtccgtg

SEQ ID NO: 4740 - DNA, 23 bp, Artificial Sequence
  Description of Artificial Sequence: Synthetic oligonucleotide
ccagactcgttaacgagtctggg

SEQ ID NO: 4741 - DNA, 23 bp, Artificial Sequence
  Description of Artificial Sequence: Synthetic oligonucleotide
tcggactcgttaacgagtccgag

SEQ ID NO: 4742 - DNA, 23 bp, Artificial Sequence
  Description of Artificial Sequence: Synthetic oligonucleotide
cctgactcgttaacgagtcaggg

SEQ ID NO: 4743 - DNA, 23 bp, Artificial Sequence
  Description of Artificial Sequence: Synthetic oligonucleotide
cacgactcgttaacgagtcgtgg

SEQ ID NO: 4744 - DNA, 23 bp, Artificial Sequence
  Description of Artificial Sequence: Synthetic oligonucleotide
gccgactcgttaacgagtcggct

SEQ ID NO: 4745 - DNA, 23 bp, Artificial Sequence
  Description of Artificial Sequence: Synthetic oligonucleotide
gccgactcgttaacgagtcggca

SEQ ID NO: 4746 - DNA, 23 bp, Artificial Sequence
  Description of Artificial Sequence: Synthetic oligonucleotide
cgagactcgttaacgagtctcgc

SEQ ID NO: 4747 - DNA, 23 bp, Artificial Sequence
  Description of Artificial Sequence: Synthetic oligonucleotide
cgtgactcgttaacgagtcacgc

SEQ ID NO: 4748 - DNA, 23 bp, Artificial Sequence
  Description of Artificial Sequence: Synthetic oligonucleotide
caggactcgttaacgagtcctgc

SEQ ID NO: 4749 - DNA, 23 bp, Artificial Sequence
  Description of Artificial Sequence: Synthetic oligonucleotide
ctggactcgttaacgagtccagc

SEQ ID NO: 4750 - DNA, 23 bp, Artificial Sequence
  Description of Artificial Sequence: Synthetic oligonucleotide
gaggactcgttaacgagtcctcg

SEQ ID NO: 4751 - DNA, 23 bp, Artificial Sequence
  Description of Artificial Sequence: Synthetic oligonucleotide
gtggactcgttaacgagtccacg

SEQ ID NO: 4752 - DNA, 23 bp, Artificial Sequence
  Description of Artificial Sequence: Synthetic oligonucleotide
accgactcgttaacgagtcggtg

SEQ ID NO: 4753 - DNA, 23 bp, Artificial Sequence
  Description of Artificial Sequence: Synthetic oligonucleotide
tccgactcgttaacgagtcggag

SEQ ID NO: 4754 - DNA, 23 bp, Artificial Sequence
  Description of Artificial Sequence: Synthetic oligonucleotide
cgggactcgttaacgagtcccgc

SEQ ID NO: 4755 - DNA, 23 bp, Artificial Sequence
  Description of Artificial Sequence: Synthetic oligonucleotide
agggactcgttaacgagtccctc

SEQ ID NO: 4756 - DNA, 23 bp, Artificial Sequence
  Description of Artificial Sequence: Synthetic oligonucleotide
tgggactcgttaacgagtcccac

SEQ ID NO: 4757 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgtgcacgagtcnnnn

SEQ ID NO: 4758 - DNA, 23 bp, Artificial Sequence
  Description of Artificial Sequence: Synthetic oligonucleotide
gcggactcgtgcacgagtccgcc

SEQ ID NO: 4759 - DNA, 23 bp, Artificial Sequence
  Description of Artificial Sequence: Synthetic oligonucleotide
gcggactcgtgcacgagtccgct

SEQ ID NO: 4760 - DNA, 23 bp, Artificial Sequence
  Description of Artificial Sequence: Synthetic oligonucleotide
acggactcgtgcacgagtccgtc

SEQ ID NO: 4761 - DNA, 23 bp, Artificial Sequence
  Description of Artificial Sequence: Synthetic oligonucleotide
gaggactcgtgcacgagtcctcc

SEQ ID NO: 4762 - DNA, 23 bp, Artificial Sequence
  Description of Artificial Sequence: Synthetic oligonucleotide
gcagactcgtgcacgagtctgcc

SEQ ID NO: 4763 - DNA, 23 bp, Artificial Sequence
  Description of Artificial Sequence: Synthetic oligonucleotide
gcggactcgtgcacgagtccgca

SEQ ID NO: 4764 - DNA, 23 bp, Artificial Sequence
  Description of Artificial Sequence: Synthetic oligonucleotide
tcggactcgtgcacgagtccgac

SEQ ID NO: 4765 - DNA, 23 bp, Artificial Sequence
  Description of Artificial Sequence: Synthetic oligonucleotide
gtggactcgtgcacgagtccacc

SEQ ID NO: 4766 - DNA, 23 bp, Artificial Sequence
  Description of Artificial Sequence: Synthetic oligonucleotide
gctgactcgtgcacgagtcagcc

SEQ ID NO: 4767 - DNA, 23 bp, Artificial Sequence
  Description of Artificial Sequence: Synthetic oligonucleotide
cccgactcgtgcacgagtcgggc

SEQ ID NO: 4768 - DNA, 23 bp, Artificial Sequence
  Description of Artificial Sequence: Synthetic oligonucleotide
cccgactcgtgcacgagtcgggt

SEQ ID NO: 4769 - DNA, 23 bp, Artificial Sequence
  Description of Artificial Sequence: Synthetic oligonucleotide
accgactcgtgcacgagtcggtc

SEQ ID NO: 4770 - DNA, 23 bp, Artificial Sequence
  Description of Artificial Sequence: Synthetic oligonucleotide
cacgactcgtgcacgagtcgtgc

SEQ ID NO: 4771 - DNA, 23 bp, Artificial Sequence
  Description of Artificial Sequence: Synthetic oligonucleotide
ccagactcgtgcacgagtctggc

SEQ ID NO: 4772 - DNA, 23 bp, Artificial Sequence
  Description of Artificial Sequence: Synthetic oligonucleotide
cccgactcgtgcacgagtcggga

SEQ ID NO: 4773 - DNA, 23 bp, Artificial Sequence
  Description of Artificial Sequence: Synthetic oligonucleotide
tccgactcgtgcacgagtcggac

SEQ ID NO: 4774 - DNA, 23 bp, Artificial Sequence
  Description of Artificial Sequence: Synthetic oligonucleotide
cctgactcgtgcacgagtcaggc

SEQ ID NO: 4775 - DNA, 23 bp, Artificial Sequence
  Description of Artificial Sequence: Synthetic oligonucleotide
ggcgactcgtgcacgagtcgccc

SEQ ID NO: 4776 - DNA, 23 bp, Artificial Sequence
  Description of Artificial Sequence: Synthetic oligonucleotide
ggcgactcgtgcacgagtcgcct

SEQ ID NO: 4777 - DNA, 23 bp, Artificial Sequence
  Description of Artificial Sequence: Synthetic oligonucleotide
agcgactcgtgcacgagtcgctc

SEQ ID NO: 4778 - DNA, 23 bp, Artificial Sequence
  Description of Artificial Sequence: Synthetic oligonucleotide
gacgactcgtgcacgagtcgtcc

SEQ ID NO: 4779 - DNA, 23 bp, Artificial Sequence
  Description of Artificial Sequence: Synthetic oligonucleotide
ggagactcgtgcacgagtctccc

SEQ ID NO: 4780 - DNA, 23 bp, Artificial Sequence
  Description of Artificial Sequence: Synthetic oligonucleotide
ggcgactcgtgcacgagtcgcca

SEQ ID NO: 4781 - DNA, 23 bp, Artificial Sequence
  Description of Artificial Sequence: Synthetic oligonucleotide
tgcgactcgtgcacgagtcgcac

SEQ ID NO: 4782 - DNA, 23 bp, Artificial Sequence
  Description of Artificial Sequence: Synthetic oligonucleotide
ggtgactcgtgcacgagtcaccc

SEQ ID NO: 4783 - DNA, 23 bp, Artificial Sequence
  Description of Artificial Sequence: Synthetic oligonucleotide
cgggactcgtgcacgagtcccgt

SEQ ID NO: 4784 - DNA, 23 bp, Artificial Sequence
  Description of Artificial Sequence: Synthetic oligonucleotide
agggactcgtgcacgagtccctg

SEQ ID NO: 4785 - DNA, 23 bp, Artificial Sequence
  Description of Artificial Sequence: Synthetic oligonucleotide
caggactcgtgcacgagtcctgg

SEQ ID NO: 4786 - DNA, 23 bp, Artificial Sequence
  Description of Artificial Sequence: Synthetic oligonucleotide
cgagactcgtgcacgagtctcgg

SEQ ID NO: 4787 - DNA, 23 bp, Artificial Sequence
  Description of Artificial Sequence: Synthetic oligonucleotide
cgggactcgtgcacgagtcccga

SEQ ID NO: 4788 - DNA, 23 bp, Artificial Sequence
  Description of Artificial Sequence: Synthetic oligonucleotide
tgggactcgtgcacgagtcccag

SEQ ID NO: 4789 - DNA, 23 bp, Artificial Sequence
  Description of Artificial Sequence: Synthetic oligonucleotide
ctggactcgtgcacgagtccagg

SEQ ID NO: 4790 - DNA, 23 bp, Artificial Sequence
  Description of Artificial Sequence: Synthetic oligonucleotide
cgtgactcgtgcacgagtcacgg

SEQ ID NO: 4791 - DNA, 23 bp, Artificial Sequence
  Description of Artificial Sequence: Synthetic oligonucleotide
ggcgactcgtgcacgagtcgccg

SEQ ID NO: 4792 - DNA, 23 bp, Artificial Sequence
  Description of Artificial Sequence: Synthetic oligonucleotide
agcgactcgtgcacgagtcgctg

SEQ ID NO: 4793 - DNA, 23 bp, Artificial Sequence
  Description of Artificial Sequence: Synthetic oligonucleotide
gacgactcgtgcacgagtcgtcg

SEQ ID NO: 4794 - DNA, 23 bp, Artificial Sequence
  Description of Artificial Sequence: Synthetic oligonucleotide
ggagactcgtgcacgagtctccg

SEQ ID NO: 4795 - DNA, 23 bp, Artificial Sequence
  Description of Artificial Sequence: Synthetic oligonucleotide
tgcgactcgtgcacgagtcgcag

SEQ ID NO: 4796 - DNA, 23 bp, Artificial Sequence
  Description of Artificial Sequence: Synthetic oligonucleotide
ggtgactcgtgcacgagtcaccg

SEQ ID NO: 4797 - DNA, 23 bp, Artificial Sequence
  Description of Artificial Sequence: Synthetic oligonucleotide
acggactcgtgcacgagtccgtg

SEQ ID NO: 4798 - DNA, 23 bp, Artificial Sequence
  Description of Artificial Sequence: Synthetic oligonucleotide
ccagactcgtgcacgagtctggg

SEQ ID NO: 4799 - DNA, 23 bp, Artificial Sequence
  Description of Artificial Sequence: Synthetic oligonucleotide
tcggactcgtgcacgagtccgag

SEQ ID NO: 4800 - DNA, 23 bp, Artificial Sequence
  Description of Artificial Sequence: Synthetic oligonucleotide
cctgactcgtgcacgagtcaggg

SEQ ID NO: 4801 - DNA, 23 bp, Artificial Sequence
  Description of Artificial Sequence: Synthetic oligonucleotide
cacgactcgtgcacgagtcgtgg

SEQ ID NO: 4802 - DNA, 23 bp, Artificial Sequence
  Description of Artificial Sequence: Synthetic oligonucleotide
gccgactcgtgcacgagtcggct

SEQ ID NO: 4803 - DNA, 23 bp, Artificial Sequence
  Description of Artificial Sequence: Synthetic oligonucleotide
gccgactcgtgcacgagtcggca

SEQ ID NO: 4804 - DNA, 23 bp, Artificial Sequence
  Description of Artificial Sequence: Synthetic oligonucleotide
cgagactcgtgcacgagtctcgc

SEQ ID NO: 4805 - DNA, 23 bp, Artificial Sequence
  Description of Artificial Sequence: Synthetic oligonucleotide
cgtgactcgtgcacgagtcacgc

SEQ ID NO: 4806 - DNA, 23 bp, Artificial Sequence
  Description of Artificial Sequence: Synthetic oligonucleotide
caggactcgtgcacgagtcctgc

SEQ ID NO: 4807 - DNA, 23 bp, Artificial Sequence
  Description of Artificial Sequence: Synthetic oligonucleotide
ctggactcgtgcacgagtccagc

SEQ ID NO: 4808 - DNA, 23 bp, Artificial Sequence
  Description of Artificial Sequence: Synthetic oligonucleotide
gaggactcgtgcacgagtcctcg

SEQ ID NO: 4809 - DNA, 23 bp, Artificial Sequence
  Description of Artificial Sequence: Synthetic oligonucleotide
gtggactcgtgcacgagtccacg

SEQ ID NO: 4810 - DNA, 23 bp, Artificial Sequence
  Description of Artificial Sequence: Synthetic oligonucleotide
accgactcgtgcacgagtcggtg

SEQ ID NO: 4811 - DNA, 23 bp, Artificial Sequence
  Description of Artificial Sequence: Synthetic oligonucleotide
tccgactcgtgcacgagtcggag

SEQ ID NO: 4812 - DNA, 23 bp, Artificial Sequence
  Description of Artificial Sequence: Synthetic oligonucleotide
cgggactcgtgcacgagtcccgc

SEQ ID NO: 4813 - DNA, 23 bp, Artificial Sequence
  Description of Artificial Sequence: Synthetic oligonucleotide
agggactcgtgcacgagtccctc

SEQ ID NO: 4814 - DNA, 23 bp, Artificial Sequence
  Description of Artificial Sequence: Synthetic oligonucleotide
tgggactcgtgcacgagtcccac

SEQ ID NO: 4815 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcgtcgacgagtcnnnn

SEQ ID NO: 4816 - DNA, 23 bp, Artificial Sequence
  Description of Artificial Sequence: Synthetic oligonucleotide
gcggactcgtcgacgagtccgcc

SEQ ID NO: 4817 - DNA, 23 bp, Artificial Sequence
  Description of Artificial Sequence: Synthetic oligonucleotide
gcggactcgtcgacgagtccgct

SEQ ID NO: 4818 - DNA, 23 bp, Artificial Sequence
  Description of Artificial Sequence: Synthetic oligonucleotide
acggactcgtcgacgagtccgtc

SEQ ID NO: 4819 - DNA, 23 bp, Artificial Sequence
  Description of Artificial Sequence: Synthetic oligonucleotide
gaggactcgtcgacgagtcctcc

SEQ ID NO: 4820 - DNA, 23 bp, Artificial Sequence
  Description of Artificial Sequence: Synthetic oligonucleotide
gcagactcgtcgacgagtctgcc

SEQ ID NO: 4821 - DNA, 23 bp, Artificial Sequence
  Description of Artificial Sequence: Synthetic oligonucleotide
gcggactcgtcgacgagtccgca

SEQ ID NO: 4822 - DNA, 23 bp, Artificial Sequence
  Description of Artificial Sequence: Synthetic oligonucleotide
tcggactcgtcgacgagtccgac

SEQ ID NO: 4823 - DNA, 23 bp, Artificial Sequence
  Description of Artificial Sequence: Synthetic oligonucleotide
gtggactcgtcgacgagtccacc

SEQ ID NO: 4824 - DNA, 23 bp, Artificial Sequence
  Description of Artificial Sequence: Synthetic oligonucleotide
gctgactcgtcgacgagtcagcc

SEQ ID NO: 4825 - DNA, 23 bp, Artificial Sequence
  Description of Artificial Sequence: Synthetic oligonucleotide
cccgactcgtcgacgagtcgggc

SEQ ID NO: 4826 - DNA, 23 bp, Artificial Sequence
  Description of Artificial Sequence: Synthetic oligonucleotide
cccgactcgtcgacgagtcgggt

SEQ ID NO: 4827 - DNA, 23 bp, Artificial Sequence
  Description of Artificial Sequence: Synthetic oligonucleotide
accgactcgtcgacgagtcggtc

SEQ ID NO: 4828 - DNA, 23 bp, Artificial Sequence
  Description of Artificial Sequence: Synthetic oligonucleotide
cacgactcgtcgacgagtcgtgc

SEQ ID NO: 4829 - DNA, 23 bp, Artificial Sequence
  Description of Artificial Sequence: Synthetic oligonucleotide
ccagactcgtcgacgagtctggc

SEQ ID NO: 4830 - DNA, 23 bp, Artificial Sequence
  Description of Artificial Sequence: Synthetic oligonucleotide
cccgactcgtcgacgagtcggga

SEQ ID NO: 4831 - DNA, 23 bp, Artificial Sequence
  Description of Artificial Sequence: Synthetic oligonucleotide
tccgactcgtcgacgagtcggac

SEQ ID NO: 4832 - DNA, 23 bp, Artificial Sequence
  Description of Artificial Sequence: Synthetic oligonucleotide
cctgactcgtcgacgagtcaggc

SEQ ID NO: 4833 - DNA, 23 bp, Artificial Sequence
  Description of Artificial Sequence: Synthetic oligonucleotide
ggcgactcgtcgacgagtcgccc

SEQ ID NO: 4834 - DNA, 23 bp, Artificial Sequence
  Description of Artificial Sequence: Synthetic oligonucleotide
ggcgactcgtcgacgagtcgcct

SEQ ID NO: 4835 - DNA, 23 bp, Artificial Sequence
  Description of Artificial Sequence: Synthetic oligonucleotide
agcgactcgtcgacgagtcgctc

SEQ ID NO: 4836 - DNA, 23 bp, Artificial Sequence
  Description of Artificial Sequence: Synthetic oligonucleotide
gacgactcgtcgacgagtcgtcc

SEQ ID NO: 4837 - DNA, 23 bp, Artificial Sequence
  Description of Artificial Sequence: Synthetic oligonucleotide
ggagactcgtcgacgagtctccc

SEQ ID NO: 4838 - DNA, 23 bp, Artificial Sequence
  Description of Artificial Sequence: Synthetic oligonucleotide
ggcgactcgtcgacgagtcgcca

SEQ ID NO: 4839 - DNA, 23 bp, Artificial Sequence
  Description of Artificial Sequence: Synthetic oligonucleotide
tgcgactcgtcgacgagtcgcac

SEQ ID NO: 4840 - DNA, 23 bp, Artificial Sequence
  Description of Artificial Sequence: Synthetic oligonucleotide
ggtgactcgtcgacgagtcaccc

SEQ ID NO: 4841 - DNA, 23 bp, Artificial Sequence
  Description of Artificial Sequence: Synthetic oligonucleotide
cgggactcgtcgacgagtcccgt

SEQ ID NO: 4842 - DNA, 23 bp, Artificial Sequence
  Description of Artificial Sequence: Synthetic oligonucleotide
agggactcgtcgacgagtccctg

SEQ ID NO: 4843 - DNA, 23 bp, Artificial Sequence
  Description of Artificial Sequence: Synthetic oligonucleotide
caggactcgtcgacgagtcctgg

SEQ ID NO: 4844 - DNA, 23 bp, Artificial Sequence
  Description of Artificial Sequence: Synthetic oligonucleotide
cgagactcgtcgacgagtctcgg

SEQ ID NO: 4845 - DNA, 23 bp, Artificial Sequence
  Description of Artificial Sequence: Synthetic oligonucleotide
cgggactcgtcgacgagtcccga

SEQ ID NO: 4846 - DNA, 23 bp, Artificial Sequence
  Description of Artificial Sequence: Synthetic oligonucleotide
tgggactcgtcgacgagtcccag

SEQ ID NO: 4847 - DNA, 23 bp, Artificial Sequence
  Description of Artificial Sequence: Synthetic oligonucleotide
ctggactcgtcgacgagtccagg

SEQ ID NO: 4848 - DNA, 23 bp, Artificial Sequence
  Description of Artificial Sequence: Synthetic oligonucleotide
cgtgactcgtcgacgagtcacgg

SEQ ID NO: 4849 - DNA, 23 bp, Artificial Sequence
  Description of Artificial Sequence: Synthetic oligonucleotide
ggcgactcgtcgacgagtcgccg

SEQ ID NO: 4850 - DNA, 23 bp, Artificial Sequence
  Description of Artificial Sequence: Synthetic oligonucleotide
agcgactcgtcgacgagtcgctg

SEQ ID NO: 4851 - DNA, 23 bp, Artificial Sequence
  Description of Artificial Sequence: Synthetic oligonucleotide
gacgactcgtcgacgagtcgtcg

SEQ ID NO: 4852 - DNA, 23 bp, Artificial Sequence
  Description of Artificial Sequence: Synthetic oligonucleotide
ggagactcgtcgacgagtctccg

SEQ ID NO: 4853 - DNA, 23 bp, Artificial Sequence
  Description of Artificial Sequence: Synthetic oligonucleotide
tgcgactcgtcgacgagtcgcag

SEQ ID NO: 4854 - DNA, 23 bp, Artificial Sequence
  Description of Artificial Sequence: Synthetic oligonucleotide
ggtgactcgtcgacgagtcaccg

SEQ ID NO: 4855 - DNA, 23 bp, Artificial Sequence
  Description of Artificial Sequence: Synthetic oligonucleotide
acggactcgtcgacgagtccgtg

SEQ ID NO: 4856 - DNA, 23 bp, Artificial Sequence
  Description of Artificial Sequence: Synthetic oligonucleotide
ccagactcgtcgacgagtctggg

SEQ ID NO: 4857 - DNA, 23 bp, Artificial Sequence
  Description of Artificial Sequence: Synthetic oligonucleotide
tcggactcgtcgacgagtccgag

SEQ ID NO: 4858 - DNA, 23 bp, Artificial Sequence
  Description of Artificial Sequence: Synthetic oligonucleotide
cctgactcgtcgacgagtcaggg

SEQ ID NO: 4859 - DNA, 23 bp, Artificial Sequence
  Description of Artificial Sequence: Synthetic oligonucleotide
cacgactcgtcgacgagtcgtgg

SEQ ID NO: 4860 - DNA, 23 bp, Artificial Sequence
  Description of Artificial Sequence: Synthetic oligonucleotide
gccgactcgtcgacgagtcggct

SEQ ID NO: 4861 - DNA, 23 bp, Artificial Sequence
  Description of Artificial Sequence: Synthetic oligonucleotide
gccgactcgtcgacgagtcggca

SEQ ID NO: 4862 - DNA, 23 bp, Artificial Sequence
  Description of Artificial Sequence: Synthetic oligonucleotide
cgagactcgtcgacgagtctcgc

SEQ ID NO: 4863 - DNA, 23 bp, Artificial Sequence
  Description of Artificial Sequence: Synthetic oligonucleotide
cgtgactcgtcgacgagtcacgc

SEQ ID NO: 4864 - DNA, 23 bp, Artificial Sequence
  Description of Artificial Sequence: Synthetic oligonucleotide
caggactcgtcgacgagtcctgc

SEQ ID NO: 4865 - DNA, 23 bp, Artificial Sequence
  Description of Artificial Sequence: Synthetic oligonucleotide
ctggactcgtcgacgagtccagc

SEQ ID NO: 4866 - DNA, 23 bp, Artificial Sequence
  Description of Artificial Sequence: Synthetic oligonucleotide
gaggactcgtcgacgagtcctcg

SEQ ID NO: 4867 - DNA, 23 bp, Artificial Sequence
  Description of Artificial Sequence: Synthetic oligonucleotide
gtggactcgtcgacgagtccacg

SEQ ID NO: 4868 - DNA, 23 bp, Artificial Sequence
  Description of Artificial Sequence: Synthetic oligonucleotide
accgactcgtcgacgagtcggtg

SEQ ID NO: 4869 - DNA, 23 bp, Artificial Sequence
  Description of Artificial Sequence: Synthetic oligonucleotide
tccgactcgtcgacgagtcggag

SEQ ID NO: 4870 - DNA, 23 bp, Artificial Sequence
  Description of Artificial Sequence: Synthetic oligonucleotide
cgggactcgtcgacgagtcccgc

SEQ ID NO: 4871 - DNA, 23 bp, Artificial Sequence
  Description of Artificial Sequence: Synthetic oligonucleotide
agggactcgtcgacgagtccctc

SEQ ID NO: 4872 - DNA, 23 bp, Artificial Sequence
  Description of Artificial Sequence: Synthetic oligonucleotide
tgggactcgtcgacgagtcccac

SEQ ID NO: 4873 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcctataggagtcnnnn

SEQ ID NO: 4874 - DNA, 23 bp, Artificial Sequence
  Description of Artificial Sequence: Synthetic oligonucleotide
gcggactcctataggagtccgcc

SEQ ID NO: 4875 - DNA, 23 bp, Artificial Sequence
  Description of Artificial Sequence: Synthetic oligonucleotide
gcggactcctataggagtccgct

SEQ ID NO: 4876 - DNA, 23 bp, Artificial Sequence
  Description of Artificial Sequence: Synthetic oligonucleotide
acggactcctataggagtccgtc

SEQ ID NO: 4877 - DNA, 23 bp, Artificial Sequence
  Description of Artificial Sequence: Synthetic oligonucleotide
gaggactcctataggagtcctcc

SEQ ID NO: 4878 - DNA, 23 bp, Artificial Sequence
  Description of Artificial Sequence: Synthetic oligonucleotide
gcagactcctataggagtctgcc

SEQ ID NO: 4879 - DNA, 23 bp, Artificial Sequence
  Description of Artificial Sequence: Synthetic oligonucleotide
gcggactcctataggagtccgca

SEQ ID NO: 4880 - DNA, 23 bp, Artificial Sequence
  Description of Artificial Sequence: Synthetic oligonucleotide
tcggactcctataggagtccgac

SEQ ID NO: 4881 - DNA, 23 bp, Artificial Sequence
  Description of Artificial Sequence: Synthetic oligonucleotide
gtggactcctataggagtccacc

SEQ ID NO: 4882 - DNA, 23 bp, Artificial Sequence
  Description of Artificial Sequence: Synthetic oligonucleotide
gctgactcctataggagtcagcc

SEQ ID NO: 4883 - DNA, 23 bp, Artificial Sequence
  Description of Artificial Sequence: Synthetic oligonucleotide
cccgactcctataggagtcgggc

SEQ ID NO: 4884 - DNA, 23 bp, Artificial Sequence
  Description of Artificial Sequence: Synthetic oligonucleotide
cccgactcctataggagtcgggt

SEQ ID NO: 4885 - DNA, 23 bp, Artificial Sequence
  Description of Artificial Sequence: Synthetic oligonucleotide
accgactcctataggagtcggtc

SEQ ID NO: 4886 - DNA, 23 bp, Artificial Sequence
  Description of Artificial Sequence: Synthetic oligonucleotide
cacgactcctataggagtcgtgc

SEQ ID NO: 4887 - DNA, 23 bp, Artificial Sequence
  Description of Artificial Sequence: Synthetic oligonucleotide
ccagactcctataggagtctggc

SEQ ID NO: 4888 - DNA, 23 bp, Artificial Sequence
  Description of Artificial Sequence: Synthetic oligonucleotide
cccgactcctataggagtcggga

SEQ ID NO: 4889 - DNA, 23 bp, Artificial Sequence
  Description of Artificial Sequence: Synthetic oligonucleotide
tccgactcctataggagtcggac

SEQ ID NO: 4890 - DNA, 23 bp, Artificial Sequence
  Description of Artificial Sequence: Synthetic oligonucleotide
cctgactcctataggagtcaggc

SEQ ID NO: 4891 - DNA, 23 bp, Artificial Sequence
  Description of Artificial Sequence: Synthetic oligonucleotide
ggcgactcctataggagtcgccc

SEQ ID NO: 4892 - DNA, 23 bp, Artificial Sequence
  Description of Artificial Sequence: Synthetic oligonucleotide
ggcgactcctataggagtcgcct

SEQ ID NO: 4893 - DNA, 23 bp, Artificial Sequence
  Description of Artificial Sequence: Synthetic oligonucleotide
agcgactcctataggagtcgctc

SEQ ID NO: 4894 - DNA, 23 bp, Artificial Sequence
  Description of Artificial Sequence: Synthetic oligonucleotide
gacgactcctataggagtcgtcc

SEQ ID NO: 4895 - DNA, 23 bp, Artificial Sequence
  Description of Artificial Sequence: Synthetic oligonucleotide
ggagactcctataggagtctccc

SEQ ID NO: 4896 - DNA, 23 bp, Artificial Sequence
  Description of Artificial Sequence: Synthetic oligonucleotide
ggcgactcctataggagtcgcca

SEQ ID NO: 4897 - DNA, 23 bp, Artificial Sequence
  Description of Artificial Sequence: Synthetic oligonucleotide
tgcgactcctataggagtcgcac

SEQ ID NO: 4898 - DNA, 23 bp, Artificial Sequence
  Description of Artificial Sequence: Synthetic oligonucleotide
ggtgactcctataggagtcaccc

SEQ ID NO: 4899 - DNA, 23 bp, Artificial Sequence
  Description of Artificial Sequence: Synthetic oligonucleotide
cgggactcctataggagtcccgt

SEQ ID NO: 4900 - DNA, 23 bp, Artificial Sequence
  Description of Artificial Sequence: Synthetic oligonucleotide
agggactcctataggagtccctg

SEQ ID NO: 4901 - DNA, 23 bp, Artificial Sequence
  Description of Artificial Sequence: Synthetic oligonucleotide
caggactcctataggagtcctgg

SEQ ID NO: 4902 - DNA, 23 bp, Artificial Sequence
  Description of Artificial Sequence: Synthetic oligonucleotide
cgagactcctataggagtctcgg

SEQ ID NO: 4903 - DNA, 23 bp, Artificial Sequence
  Description of Artificial Sequence: Synthetic oligonucleotide
cgggactcctataggagtcccga

SEQ ID NO: 4904 - DNA, 23 bp, Artificial Sequence
  Description of Artificial Sequence: Synthetic oligonucleotide
tgggactcctataggagtcccag

SEQ ID NO: 4905 - DNA, 23 bp, Artificial Sequence
  Description of Artificial Sequence: Synthetic oligonucleotide
ctggactcctataggagtccagg

SEQ ID NO: 4906 - DNA, 23 bp, Artificial Sequence
  Description of Artificial Sequence: Synthetic oligonucleotide
cgtgactcctataggagtcacgg

SEQ ID NO: 4907 - DNA, 23 bp, Artificial Sequence
  Description of Artificial Sequence: Synthetic oligonucleotide
ggcgactcctataggagtcgccg

SEQ ID NO: 4908 - DNA, 23 bp, Artificial Sequence
  Description of Artificial Sequence: Synthetic oligonucleotide
agcgactcctataggagtcgctg

SEQ ID NO: 4909 - DNA, 23 bp, Artificial Sequence
  Description of Artificial Sequence: Synthetic oligonucleotide
gacgactcctataggagtcgtcg

SEQ ID NO: 4910 - DNA, 23 bp, Artificial Sequence
  Description of Artificial Sequence: Synthetic oligonucleotide
ggagactcctataggagtctccg

SEQ ID NO: 4911 - DNA, 23 bp, Artificial Sequence
  Description of Artificial Sequence: Synthetic oligonucleotide
tgcgactcctataggagtcgcag

SEQ ID NO: 4912 - DNA, 23 bp, Artificial Sequence
  Description of Artificial Sequence: Synthetic oligonucleotide
ggtgactcctataggagtcaccg

SEQ ID NO: 4913 - DNA, 23 bp, Artificial Sequence
  Description of Artificial Sequence: Synthetic oligonucleotide
acggactcctataggagtccgtg

SEQ ID NO: 4914 - DNA, 23 bp, Artificial Sequence
  Description of Artificial Sequence: Synthetic oligonucleotide
ccagactcctataggagtctggg

SEQ ID NO: 4915 - DNA, 23 bp, Artificial Sequence
  Description of Artificial Sequence: Synthetic oligonucleotide
tcggactcctataggagtccgag

SEQ ID NO: 4916 - DNA, 23 bp, Artificial Sequence
  Description of Artificial Sequence: Synthetic oligonucleotide
cctgactcctataggagtcaggg

SEQ ID NO: 4917 - DNA, 23 bp, Artificial Sequence
  Description of Artificial Sequence: Synthetic oligonucleotide
cacgactcctataggagtcgtgg

SEQ ID NO: 4918 - DNA, 23 bp, Artificial Sequence
  Description of Artificial Sequence: Synthetic oligonucleotide
gccgactcctataggagtcggct

SEQ ID NO: 4919 - DNA, 23 bp, Artificial Sequence
  Description of Artificial Sequence: Synthetic oligonucleotide
gccgactcctataggagtcggca

SEQ ID NO: 4920 - DNA, 23 bp, Artificial Sequence
  Description of Artificial Sequence: Synthetic oligonucleotide
cgagactcctataggagtctcgc

SEQ ID NO: 4921 - DNA, 23 bp, Artificial Sequence
  Description of Artificial Sequence: Synthetic oligonucleotide
cgtgactcctataggagtcacgc

SEQ ID NO: 4922 - DNA, 23 bp, Artificial Sequence
  Description of Artificial Sequence: Synthetic oligonucleotide
caggactcctataggagtcctgc

SEQ ID NO: 4923 - DNA, 23 bp, Artificial Sequence
  Description of Artificial Sequence: Synthetic oligonucleotide
ctggactcctataggagtccagc

SEQ ID NO: 4924 - DNA, 23 bp, Artificial Sequence
  Description of Artificial Sequence: Synthetic oligonucleotide
gaggactcctataggagtcctcg

SEQ ID NO: 4925 - DNA, 23 bp, Artificial Sequence
  Description of Artificial Sequence: Synthetic oligonucleotide
gtggactcctataggagtccacg

SEQ ID NO: 4926 - DNA, 23 bp, Artificial Sequence
  Description of Artificial Sequence: Synthetic oligonucleotide
accgactcctataggagtcggtg

SEQ ID NO: 4927 - DNA, 23 bp, Artificial Sequence
  Description of Artificial Sequence: Synthetic oligonucleotide
tccgactcctataggagtcggag

SEQ ID NO: 4928 - DNA, 23 bp, Artificial Sequence
  Description of Artificial Sequence: Synthetic oligonucleotide
cgggactcctataggagtcccgc

SEQ ID NO: 4929 - DNA, 23 bp, Artificial Sequence
  Description of Artificial Sequence: Synthetic oligonucleotide
agggactcctataggagtccctc

SEQ ID NO: 4930 - DNA, 23 bp, Artificial Sequence
  Description of Artificial Sequence: Synthetic oligonucleotide
tgggactcctataggagtcccac

SEQ ID NO: 4931 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccttaaggagtcnnnn

SEQ ID NO: 4932 - DNA, 23 bp, Artificial Sequence
  Description of Artificial Sequence: Synthetic oligonucleotide
gcggactccttaaggagtccgcc

SEQ ID NO: 4933 - DNA, 23 bp, Artificial Sequence
  Description of Artificial Sequence: Synthetic oligonucleotide
gcggactccttaaggagtccgct

SEQ ID NO: 4934 - DNA, 23 bp, Artificial Sequence
  Description of Artificial Sequence: Synthetic oligonucleotide
acggactccttaaggagtccgtc

SEQ ID NO: 4935 - DNA, 23 bp, Artificial Sequence
  Description of Artificial Sequence: Synthetic oligonucleotide
gaggactccttaaggagtcctcc

SEQ ID NO: 4936 - DNA, 23 bp, Artificial Sequence
  Description of Artificial Sequence: Synthetic oligonucleotide
gcagactccttaaggagtctgcc

SEQ ID NO: 4937 - DNA, 23 bp, Artificial Sequence
  Description of Artificial Sequence: Synthetic oligonucleotide
gcggactccttaaggagtccgca

SEQ ID NO: 4938 - DNA, 23 bp, Artificial Sequence
  Description of Artificial Sequence: Synthetic oligonucleotide
tcggactccttaaggagtccgac

SEQ ID NO: 4939 - DNA, 23 bp, Artificial Sequence
  Description of Artificial Sequence: Synthetic oligonucleotide
gtggactccttaaggagtccacc

SEQ ID NO: 4940 - DNA, 23 bp, Artificial Sequence
  Description of Artificial Sequence: Synthetic oligonucleotide
gctgactccttaaggagtcagcc

SEQ ID NO: 4941 - DNA, 23 bp, Artificial Sequence
  Description of Artificial Sequence: Synthetic oligonucleotide
cccgactccttaaggagtcgggc

SEQ ID NO: 4942 - DNA, 23 bp, Artificial Sequence
  Description of Artificial Sequence: Synthetic oligonucleotide
cccgactccttaaggagtcgggt

SEQ ID NO: 4943 - DNA, 23 bp, Artificial Sequence
  Description of Artificial Sequence: Synthetic oligonucleotide
accgactccttaaggagtcggtc

SEQ ID NO: 4944 - DNA, 23 bp, Artificial Sequence
  Description of Artificial Sequence: Synthetic oligonucleotide
cacgactccttaaggagtcgtgc

SEQ ID NO: 4945 - DNA, 23 bp, Artificial Sequence
  Description of Artificial Sequence: Synthetic oligonucleotide
ccagactccttaaggagtctggc

SEQ ID NO: 4946 - DNA, 23 bp, Artificial Sequence
  Description of Artificial Sequence: Synthetic oligonucleotide
cccgactccttaaggagtcggga

SEQ ID NO: 4947 - DNA, 23 bp, Artificial Sequence
  Description of Artificial Sequence: Synthetic oligonucleotide
tccgactccttaaggagtcggac

SEQ ID NO: 4948 - DNA, 23 bp, Artificial Sequence
  Description of Artificial Sequence: Synthetic oligonucleotide
cctgactccttaaggagtcaggc

SEQ ID NO: 4949 - DNA, 23 bp, Artificial Sequence
  Description of Artificial Sequence: Synthetic oligonucleotide
ggcgactccttaaggagtcgccc

SEQ ID NO: 4950 - DNA, 23 bp, Artificial Sequence
  Description of Artificial Sequence: Synthetic oligonucleotide
ggcgactccttaaggagtcgcct

SEQ ID NO: 4951 - DNA, 23 bp, Artificial Sequence
  Description of Artificial Sequence: Synthetic oligonucleotide
agcgactccttaaggagtcgctc

SEQ ID NO: 4952 - DNA, 23 bp, Artificial Sequence
  Description of Artificial Sequence: Synthetic oligonucleotide
gacgactccttaaggagtcgtcc

SEQ ID NO: 4953 - DNA, 23 bp, Artificial Sequence
  Description of Artificial Sequence: Synthetic oligonucleotide
ggagactccttaaggagtctccc

SEQ ID NO: 4954 - DNA, 23 bp, Artificial Sequence
  Description of Artificial Sequence: Synthetic oligonucleotide
ggcgactccttaaggagtcgcca

SEQ ID NO: 4955 - DNA, 23 bp, Artificial Sequence
  Description of Artificial Sequence: Synthetic oligonucleotide
tgcgactccttaaggagtcgcac

SEQ ID NO: 4956 - DNA, 23 bp, Artificial Sequence
  Description of Artificial Sequence: Synthetic oligonucleotide
ggtgactccttaaggagtcaccc

SEQ ID NO: 4957 - DNA, 23 bp, Artificial Sequence
  Description of Artificial Sequence: Synthetic oligonucleotide
cgggactccttaaggagtcccgt

SEQ ID NO: 4958 - DNA, 23 bp, Artificial Sequence
  Description of Artificial Sequence: Synthetic oligonucleotide
agggactccttaaggagtccctg

SEQ ID NO: 4959 - DNA, 23 bp, Artificial Sequence
  Description of Artificial Sequence: Synthetic oligonucleotide
caggactccttaaggagtcctgg

SEQ ID NO: 4960 - DNA, 23 bp, Artificial Sequence
  Description of Artificial Sequence: Synthetic oligonucleotide
cgagactccttaaggagtctcgg

SEQ ID NO: 4961 - DNA, 23 bp, Artificial Sequence
  Description of Artificial Sequence: Synthetic oligonucleotide
cgggactccttaaggagtcccga

SEQ ID NO: 4962 - DNA, 23 bp, Artificial Sequence
  Description of Artificial Sequence: Synthetic oligonucleotide
tgggactccttaaggagtcccag

SEQ ID NO: 4963 - DNA, 23 bp, Artificial Sequence
  Description of Artificial Sequence: Synthetic oligonucleotide
ctggactccttaaggagtccagg

SEQ ID NO: 4964 - DNA, 23 bp, Artificial Sequence
  Description of Artificial Sequence: Synthetic oligonucleotide
cgtgactccttaaggagtcacgg

SEQ ID NO: 4965 - DNA, 23 bp, Artificial Sequence
  Description of Artificial Sequence: Synthetic oligonucleotide
ggcgactccttaaggagtcgccg

SEQ ID NO: 4966 - DNA, 23 bp, Artificial Sequence
  Description of Artificial Sequence: Synthetic oligonucleotide
agcgactccttaaggagtcgctg

SEQ ID NO: 4967 - DNA, 23 bp, Artificial Sequence
  Description of Artificial Sequence: Synthetic oligonucleotide
gacgactccttaaggagtcgtcg

SEQ ID NO: 4968 - DNA, 23 bp, Artificial Sequence
  Description of Artificial Sequence: Synthetic oligonucleotide
ggagactccttaaggagtctccg

SEQ ID NO: 4969 - DNA, 23 bp, Artificial Sequence
  Description of Artificial Sequence: Synthetic oligonucleotide
tgcgactccttaaggagtcgcag

SEQ ID NO: 4970 - DNA, 23 bp, Artificial Sequence
  Description of Artificial Sequence: Synthetic oligonucleotide
ggtgactccttaaggagtcaccg

SEQ ID NO: 4971 - DNA, 23 bp, Artificial Sequence
  Description of Artificial Sequence: Synthetic oligonucleotide
acggactccttaaggagtccgtg

SEQ ID NO: 4972 - DNA, 23 bp, Artificial Sequence
  Description of Artificial Sequence: Synthetic oligonucleotide
ccagactccttaaggagtctggg

SEQ ID NO: 4973 - DNA, 23 bp, Artificial Sequence
  Description of Artificial Sequence: Synthetic oligonucleotide
tcggactccttaaggagtccgag

SEQ ID NO: 4974 - DNA, 23 bp, Artificial Sequence
  Description of Artificial Sequence: Synthetic oligonucleotide
cctgactccttaaggagtcaggg

SEQ ID NO: 4975 - DNA, 23 bp, Artificial Sequence
  Description of Artificial Sequence: Synthetic oligonucleotide
cacgactccttaaggagtcgtgg

SEQ ID NO: 4976 - DNA, 23 bp, Artificial Sequence
  Description of Artificial Sequence: Synthetic oligonucleotide
gccgactccttaaggagtcggct

SEQ ID NO: 4977 - DNA, 23 bp, Artificial Sequence
  Description of Artificial Sequence: Synthetic oligonucleotide
gccgactccttaaggagtcggca

SEQ ID NO: 4978 - DNA, 23 bp, Artificial Sequence
  Description of Artificial Sequence: Synthetic oligonucleotide
cgagactccttaaggagtctcgc

SEQ ID NO: 4979 - DNA, 23 bp, Artificial Sequence
  Description of Artificial Sequence: Synthetic oligonucleotide
cgtgactccttaaggagtcacgc

SEQ ID NO: 4980 - DNA, 23 bp, Artificial Sequence
  Description of Artificial Sequence: Synthetic oligonucleotide
caggactccttaaggagtcctgc

SEQ ID NO: 4981 - DNA, 23 bp, Artificial Sequence
  Description of Artificial Sequence: Synthetic oligonucleotide
ctggactccttaaggagtccagc

SEQ ID NO: 4982 - DNA, 23 bp, Artificial Sequence
  Description of Artificial Sequence: Synthetic oligonucleotide
gaggactccttaaggagtcctcg

SEQ ID NO: 4983 - DNA, 23 bp, Artificial Sequence
  Description of Artificial Sequence: Synthetic oligonucleotide
gtggactccttaaggagtccacg

SEQ ID NO: 4984 - DNA, 23 bp, Artificial Sequence
  Description of Artificial Sequence: Synthetic oligonucleotide
accgactccttaaggagtcggtg

SEQ ID NO: 4985 - DNA, 23 bp, Artificial Sequence
  Description of Artificial Sequence: Synthetic oligonucleotide
tccgactccttaaggagtcggag

SEQ ID NO: 4986 - DNA, 23 bp, Artificial Sequence
  Description of Artificial Sequence: Synthetic oligonucleotide
cgggactccttaaggagtcccgc

SEQ ID NO: 4987 - DNA, 23 bp, Artificial Sequence
  Description of Artificial Sequence: Synthetic oligonucleotide
agggactccttaaggagtccctc

SEQ ID NO: 4988 - DNA, 23 bp, Artificial Sequence
  Description of Artificial Sequence: Synthetic oligonucleotide
tgggactccttaaggagtcccac

SEQ ID NO: 4989 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcctgcaggagtcnnnn

SEQ ID NO: 4990 - DNA, 23 bp, Artificial Sequence
  Description of Artificial Sequence: Synthetic oligonucleotide
gcggactcctgcaggagtccgcc

SEQ ID NO: 4991 - DNA, 23 bp, Artificial Sequence
  Description of Artificial Sequence: Synthetic oligonucleotide
gcggactcctgcaggagtccgct

SEQ ID NO: 4992 - DNA, 23 bp, Artificial Sequence
  Description of Artificial Sequence: Synthetic oligonucleotide
acggactcctgcaggagtccgtc

SEQ ID NO: 4993 - DNA, 23 bp, Artificial Sequence
  Description of Artificial Sequence: Synthetic oligonucleotide
gaggactcctgcaggagtcctcc

SEQ ID NO: 4994 - DNA, 23 bp, Artificial Sequence
  Description of Artificial Sequence: Synthetic oligonucleotide
gcagactcctgcaggagtctgcc

SEQ ID NO: 4995 - DNA, 23 bp, Artificial Sequence
  Description of Artificial Sequence: Synthetic oligonucleotide
gcggactcctgcaggagtccgca

SEQ ID NO: 4996 - DNA, 23 bp, Artificial Sequence
  Description of Artificial Sequence: Synthetic oligonucleotide
tcggactcctgcaggagtccgac

SEQ ID NO: 4997 - DNA, 23 bp, Artificial Sequence
  Description of Artificial Sequence: Synthetic oligonucleotide
gtggactcctgcaggagtccacc

SEQ ID NO: 4998 - DNA, 23 bp, Artificial Sequence
  Description of Artificial Sequence: Synthetic oligonucleotide
gctgactcctgcaggagtcagcc

SEQ ID NO: 4999 - DNA, 23 bp, Artificial Sequence
  Description of Artificial Sequence: Synthetic oligonucleotide
cccgactcctgcaggagtcgggc

SEQ ID NO: 5000 - DNA, 23 bp, Artificial Sequence
  Description of Artificial Sequence: Synthetic oligonucleotide
cccgactcctgcaggagtcgggt

SEQ ID NO: 5001 - DNA, 23 bp, Artificial Sequence
  Description of Artificial Sequence: Synthetic oligonucleotide
accgactcctgcaggagtcggtc

SEQ ID NO: 5002 - DNA, 23 bp, Artificial Sequence
  Description of Artificial Sequence: Synthetic oligonucleotide
cacgactcctgcaggagtcgtgc

SEQ ID NO: 5003 - DNA, 23 bp, Artificial Sequence
  Description of Artificial Sequence: Synthetic oligonucleotide
ccagactcctgcaggagtctggc

SEQ ID NO: 5004 - DNA, 23 bp, Artificial Sequence
  Description of Artificial Sequence: Synthetic oligonucleotide
cccgactcctgcaggagtcggga

SEQ ID NO: 5005 - DNA, 23 bp, Artificial Sequence
  Description of Artificial Sequence: Synthetic oligonucleotide
tccgactcctgcaggagtcggac

SEQ ID NO: 5006 - DNA, 23 bp, Artificial Sequence
  Description of Artificial Sequence: Synthetic oligonucleotide
cctgactcctgcaggagtcaggc

SEQ ID NO: 5007 - DNA, 23 bp, Artificial Sequence
  Description of Artificial Sequence: Synthetic oligonucleotide
ggcgactcctgcaggagtcgccc

SEQ ID NO: 5008 - DNA, 23 bp, Artificial Sequence
  Description of Artificial Sequence: Synthetic oligonucleotide
ggcgactcctgcaggagtcgcct

SEQ ID NO: 5009 - DNA, 23 bp, Artificial Sequence
  Description of Artificial Sequence: Synthetic oligonucleotide
agcgactcctgcaggagtcgctc

SEQ ID NO: 5010 - DNA, 23 bp, Artificial Sequence
  Description of Artificial Sequence: Synthetic oligonucleotide
gacgactcctgcaggagtcgtcc

SEQ ID NO: 5011 - DNA, 23 bp, Artificial Sequence
  Description of Artificial Sequence: Synthetic oligonucleotide
ggagactcctgcaggagtctccc

SEQ ID NO: 5012 - DNA, 23 bp, Artificial Sequence
  Description of Artificial Sequence: Synthetic oligonucleotide
ggcgactcctgcaggagtcgcca

SEQ ID NO: 5013 - DNA, 23 bp, Artificial Sequence
  Description of Artificial Sequence: Synthetic oligonucleotide
tgcgactcctgcaggagtcgcac

SEQ ID NO: 5014 - DNA, 23 bp, Artificial Sequence
  Description of Artificial Sequence: Synthetic oligonucleotide
ggtgactcctgcaggagtcaccc

SEQ ID NO: 5015 - DNA, 23 bp, Artificial Sequence
  Description of Artificial Sequence: Synthetic oligonucleotide
cgggactcctgcaggagtcccgt

SEQ ID NO: 5016 - DNA, 23 bp, Artificial Sequence
  Description of Artificial Sequence: Synthetic oligonucleotide
agggactcctgcaggagtccctg

SEQ ID NO: 5017 - DNA, 23 bp, Artificial Sequence
  Description of Artificial Sequence: Synthetic oligonucleotide
caggactcctgcaggagtcctgg

SEQ ID NO: 5018 - DNA, 23 bp, Artificial Sequence
  Description of Artificial Sequence: Synthetic oligonucleotide
cgagactcctgcaggagtctcgg

SEQ ID NO: 5019 - DNA, 23 bp, Artificial Sequence
  Description of Artificial Sequence: Synthetic oligonucleotide
cgggactcctgcaggagtcccga

SEQ ID NO: 5020 - DNA, 23 bp, Artificial Sequence
  Description of Artificial Sequence: Synthetic oligonucleotide
tgggactcctgcaggagtcccag

SEQ ID NO: 5021 - DNA, 23 bp, Artificial Sequence
  Description of Artificial Sequence: Synthetic oligonucleotide
ctggactcctgcaggagtccagg

SEQ ID NO: 5022 - DNA, 23 bp, Artificial Sequence
  Description of Artificial Sequence: Synthetic oligonucleotide
cgtgactcctgcaggagtcacgg

SEQ ID NO: 5023 - DNA, 23 bp, Artificial Sequence
  Description of Artificial Sequence: Synthetic oligonucleotide
ggcgactcctgcaggagtcgccg

SEQ ID NO: 5024 - DNA, 23 bp, Artificial Sequence
  Description of Artificial Sequence: Synthetic oligonucleotide
agcgactcctgcaggagtcgctg

SEQ ID NO: 5025 - DNA, 23 bp, Artificial Sequence
  Description of Artificial Sequence: Synthetic oligonucleotide
gacgactcctgcaggagtcgtcg

SEQ ID NO: 5026 - DNA, 23 bp, Artificial Sequence
  Description of Artificial Sequence: Synthetic oligonucleotide
ggagactcctgcaggagtctccg

SEQ ID NO: 5027 - DNA, 23 bp, Artificial Sequence
  Description of Artificial Sequence: Synthetic oligonucleotide
tgcgactcctgcaggagtcgcag

SEQ ID NO: 5028 - DNA, 23 bp, Artificial Sequence
  Description of Artificial Sequence: Synthetic oligonucleotide
ggtgactcctgcaggagtcaccg

SEQ ID NO: 5029 - DNA, 23 bp, Artificial Sequence
  Description of Artificial Sequence: Synthetic oligonucleotide
acggactcctgcaggagtccgtg

SEQ ID NO: 5030 - DNA, 23 bp, Artificial Sequence
  Description of Artificial Sequence: Synthetic oligonucleotide
ccagactcctgcaggagtctggg

SEQ ID NO: 5031 - DNA, 23 bp, Artificial Sequence
  Description of Artificial Sequence: Synthetic oligonucleotide
tcggactcctgcaggagtccgag

SEQ ID NO: 5032 - DNA, 23 bp, Artificial Sequence
  Description of Artificial Sequence: Synthetic oligonucleotide
cctgactcctgcaggagtcaggg

SEQ ID NO: 5033 - DNA, 23 bp, Artificial Sequence
  Description of Artificial Sequence: Synthetic oligonucleotide
cacgactcctgcaggagtcgtgg

SEQ ID NO: 5034 - DNA, 23 bp, Artificial Sequence
  Description of Artificial Sequence: Synthetic oligonucleotide
gccgactcctgcaggagtcggct

SEQ ID NO: 5035 - DNA, 23 bp, Artificial Sequence
  Description of Artificial Sequence: Synthetic oligonucleotide
gccgactcctgcaggagtcggca

SEQ ID NO: 5036 - DNA, 23 bp, Artificial Sequence
  Description of Artificial Sequence: Synthetic oligonucleotide
cgagactcctgcaggagtctcgc

SEQ ID NO: 5037 - DNA, 23 bp, Artificial Sequence
  Description of Artificial Sequence: Synthetic oligonucleotide
cgtgactcctgcaggagtcacgc

SEQ ID NO: 5038 - DNA, 23 bp, Artificial Sequence
  Description of Artificial Sequence: Synthetic oligonucleotide
caggactcctgcaggagtcctgc

SEQ ID NO: 5039 - DNA, 23 bp, Artificial Sequence
  Description of Artificial Sequence: Synthetic oligonucleotide
ctggactcctgcaggagtccagc

SEQ ID NO: 5040 - DNA, 23 bp, Artificial Sequence
  Description of Artificial Sequence: Synthetic oligonucleotide
gaggactcctgcaggagtcctcg

SEQ ID NO: 5041 - DNA, 23 bp, Artificial Sequence
  Description of Artificial Sequence: Synthetic oligonucleotide
gtggactcctgcaggagtccacg

SEQ ID NO: 5042 - DNA, 23 bp, Artificial Sequence
  Description of Artificial Sequence: Synthetic oligonucleotide
accgactcctgcaggagtcggtg

SEQ ID NO: 5043 - DNA, 23 bp, Artificial Sequence
  Description of Artificial Sequence: Synthetic oligonucleotide
tccgactcctgcaggagtcggag

SEQ ID NO: 5044 - DNA, 23 bp, Artificial Sequence
  Description of Artificial Sequence: Synthetic oligonucleotide
cgggactcctgcaggagtcccgc

SEQ ID NO: 5045 - DNA, 23 bp, Artificial Sequence
  Description of Artificial Sequence: Synthetic oligonucleotide
agggactcctgcaggagtccctc

SEQ ID NO: 5046 - DNA, 23 bp, Artificial Sequence
  Description of Artificial Sequence: Synthetic oligonucleotide
tgggactcctgcaggagtcccac

SEQ ID NO: 5047 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcctcgaggagtcnnnn

SEQ ID NO: 5048 - DNA, 23 bp, Artificial Sequence
  Description of Artificial Sequence: Synthetic oligonucleotide
gcggactcctcgaggagtccgcc

SEQ ID NO: 5049 - DNA, 23 bp, Artificial Sequence
  Description of Artificial Sequence: Synthetic oligonucleotide
gcggactcctcgaggagtccgct

SEQ ID NO: 5050 - DNA, 23 bp, Artificial Sequence
  Description of Artificial Sequence: Synthetic oligonucleotide
acggactcctcgaggagtccgtc

SEQ ID NO: 5051 - DNA, 23 bp, Artificial Sequence
  Description of Artificial Sequence: Synthetic oligonucleotide
gaggactcctcgaggagtcctcc

SEQ ID NO: 5052 - DNA, 23 bp, Artificial Sequence
  Description of Artificial Sequence: Synthetic oligonucleotide
gcagactcctcgaggagtctgcc

SEQ ID NO: 5053 - DNA, 23 bp, Artificial Sequence
  Description of Artificial Sequence: Synthetic oligonucleotide
gcggactcctcgaggagtccgca

SEQ ID NO: 5054 - DNA, 23 bp, Artificial Sequence
  Description of Artificial Sequence: Synthetic oligonucleotide
tcggactcctcgaggagtccgac

SEQ ID NO: 5055 - DNA, 23 bp, Artificial Sequence
  Description of Artificial Sequence: Synthetic oligonucleotide
gtggactcctcgaggagtccacc

SEQ ID NO: 5056 - DNA, 23 bp, Artificial Sequence
  Description of Artificial Sequence: Synthetic oligonucleotide
gctgactcctcgaggagtcagcc

SEQ ID NO: 5057 - DNA, 23 bp, Artificial Sequence
  Description of Artificial Sequence: Synthetic oligonucleotide
cccgactcctcgaggagtcgggc

SEQ ID NO: 5058 - DNA, 23 bp, Artificial Sequence
  Description of Artificial Sequence: Synthetic oligonucleotide
cccgactcctcgaggagtcgggt

SEQ ID NO: 5059 - DNA, 23 bp, Artificial Sequence
  Description of Artificial Sequence: Synthetic oligonucleotide
accgactcctcgaggagtcggtc

SEQ ID NO: 5060 - DNA, 23 bp, Artificial Sequence
  Description of Artificial Sequence: Synthetic oligonucleotide
cacgactcctcgaggagtcgtgc

SEQ ID NO: 5061 - DNA, 23 bp, Artificial Sequence
  Description of Artificial Sequence: Synthetic oligonucleotide
ccagactcctcgaggagtctggc

SEQ ID NO: 5062 - DNA, 23 bp, Artificial Sequence
  Description of Artificial Sequence: Synthetic oligonucleotide
cccgactcctcgaggagtcggga

SEQ ID NO: 5063 - DNA, 23 bp, Artificial Sequence
  Description of Artificial Sequence: Synthetic oligonucleotide
tccgactcctcgaggagtcggac

SEQ ID NO: 5064 - DNA, 23 bp, Artificial Sequence
  Description of Artificial Sequence: Synthetic oligonucleotide
cctgactcctcgaggagtcaggc

SEQ ID NO: 5065 - DNA, 23 bp, Artificial Sequence
  Description of Artificial Sequence: Synthetic oligonucleotide
ggcgactcctcgaggagtcgccc

SEQ ID NO: 5066 - DNA, 23 bp, Artificial Sequence
  Description of Artificial Sequence: Synthetic oligonucleotide
ggcgactcctcgaggagtcgcct

SEQ ID NO: 5067 - DNA, 23 bp, Artificial Sequence
  Description of Artificial Sequence: Synthetic oligonucleotide
agcgactcctcgaggagtcgctc

SEQ ID NO: 5068 - DNA, 23 bp, Artificial Sequence
  Description of Artificial Sequence: Synthetic oligonucleotide
gacgactcctcgaggagtcgtcc

SEQ ID NO: 5069 - DNA, 23 bp, Artificial Sequence
  Description of Artificial Sequence: Synthetic oligonucleotide
ggagactcctcgaggagtctccc

SEQ ID NO: 5070 - DNA, 23 bp, Artificial Sequence
  Description of Artificial Sequence: Synthetic oligonucleotide
ggcgactcctcgaggagtcgcca

SEQ ID NO: 5071 - DNA, 23 bp, Artificial Sequence
  Description of Artificial Sequence: Synthetic oligonucleotide
tgcgactcctcgaggagtcgcac

SEQ ID NO: 5072 - DNA, 23 bp, Artificial Sequence
  Description of Artificial Sequence: Synthetic oligonucleotide
ggtgactcctcgaggagtcaccc

SEQ ID NO: 5073 - DNA, 23 bp, Artificial Sequence
  Description of Artificial Sequence: Synthetic oligonucleotide
cgggactcctcgaggagtcccgt

SEQ ID NO: 5074 - DNA, 23 bp, Artificial Sequence
  Description of Artificial Sequence: Synthetic oligonucleotide
agggactcctcgaggagtccctg

SEQ ID NO: 5075 - DNA, 23 bp, Artificial Sequence
  Description of Artificial Sequence: Synthetic oligonucleotide
caggactcctcgaggagtcctgg

SEQ ID NO: 5076 - DNA, 23 bp, Artificial Sequence
  Description of Artificial Sequence: Synthetic oligonucleotide
cgagactcctcgaggagtctcgg

SEQ ID NO: 5077 - DNA, 23 bp, Artificial Sequence
  Description of Artificial Sequence: Synthetic oligonucleotide
cgggactcctcgaggagtcccga

SEQ ID NO: 5078 - DNA, 23 bp, Artificial Sequence
  Description of Artificial Sequence: Synthetic oligonucleotide
tgggactcctcgaggagtcccag

SEQ ID NO: 5079 - DNA, 23 bp, Artificial Sequence
  Description of Artificial Sequence: Synthetic oligonucleotide
ctggactcctcgaggagtccagg

SEQ ID NO: 5080 - DNA, 23 bp, Artificial Sequence
  Description of Artificial Sequence: Synthetic oligonucleotide
cgtgactcctcgaggagtcacgg

SEQ ID NO: 5081 - DNA, 23 bp, Artificial Sequence
  Description of Artificial Sequence: Synthetic oligonucleotide
ggcgactcctcgaggagtcgccg

SEQ ID NO: 5082 - DNA, 23 bp, Artificial Sequence
  Description of Artificial Sequence: Synthetic oligonucleotide
agcgactcctcgaggagtcgctg

SEQ ID NO: 5083 - DNA, 23 bp, Artificial Sequence
  Description of Artificial Sequence: Synthetic oligonucleotide
gacgactcctcgaggagtcgtcg

SEQ ID NO: 5084 - DNA, 23 bp, Artificial Sequence
  Description of Artificial Sequence: Synthetic oligonucleotide
ggagactcctcgaggagtctccg

SEQ ID NO: 5085 - DNA, 23 bp, Artificial Sequence
  Description of Artificial Sequence: Synthetic oligonucleotide
tgcgactcctcgaggagtcgcag

SEQ ID NO: 5086 - DNA, 23 bp, Artificial Sequence
  Description of Artificial Sequence: Synthetic oligonucleotide
ggtgactcctcgaggagtcaccg

SEQ ID NO: 5087 - DNA, 23 bp, Artificial Sequence
  Description of Artificial Sequence: Synthetic oligonucleotide
acggactcctcgaggagtccgtg

SEQ ID NO: 5088 - DNA, 23 bp, Artificial Sequence
  Description of Artificial Sequence: Synthetic oligonucleotide
ccagactcctcgaggagtctggg

SEQ ID NO: 5089 - DNA, 23 bp, Artificial Sequence
  Description of Artificial Sequence: Synthetic oligonucleotide
tcggactcctcgaggagtccgag

SEQ ID NO: 5090 - DNA, 23 bp, Artificial Sequence
  Description of Artificial Sequence: Synthetic oligonucleotide
cctgactcctcgaggagtcaggg

SEQ ID NO: 5091 - DNA, 23 bp, Artificial Sequence
  Description of Artificial Sequence: Synthetic oligonucleotide
cacgactcctcgaggagtcgtgg

SEQ ID NO: 5092 - DNA, 23 bp, Artificial Sequence
  Description of Artificial Sequence: Synthetic oligonucleotide
gccgactcctcgaggagtcggct

SEQ ID NO: 5093 - DNA, 23 bp, Artificial Sequence
  Description of Artificial Sequence: Synthetic oligonucleotide
gccgactcctcgaggagtcggca

SEQ ID NO: 5094 - DNA, 23 bp, Artificial Sequence
  Description of Artificial Sequence: Synthetic oligonucleotide
cgagactcctcgaggagtctcgc

SEQ ID NO: 5095 - DNA, 23 bp, Artificial Sequence
  Description of Artificial Sequence: Synthetic oligonucleotide
cgtgactcctcgaggagtcacgc

SEQ ID NO: 5096 - DNA, 23 bp, Artificial Sequence
  Description of Artificial Sequence: Synthetic oligonucleotide
caggactcctcgaggagtcctgc

SEQ ID NO: 5097 - DNA, 23 bp, Artificial Sequence
  Description of Artificial Sequence: Synthetic oligonucleotide
ctggactcctcgaggagtccagc

SEQ ID NO: 5098 - DNA, 23 bp, Artificial Sequence
  Description of Artificial Sequence: Synthetic oligonucleotide
gaggactcctcgaggagtcctcg

SEQ ID NO: 5099 - DNA, 23 bp, Artificial Sequence
  Description of Artificial Sequence: Synthetic oligonucleotide
gtggactcctcgaggagtccacg

SEQ ID NO: 5100 - DNA, 23 bp, Artificial Sequence
  Description of Artificial Sequence: Synthetic oligonucleotide
accgactcctcgaggagtcggtg

SEQ ID NO: 5101 - DNA, 23 bp, Artificial Sequence
  Description of Artificial Sequence: Synthetic oligonucleotide
tccgactcctcgaggagtcggag

SEQ ID NO: 5102 - DNA, 23 bp, Artificial Sequence
  Description of Artificial Sequence: Synthetic oligonucleotide
cgggactcctcgaggagtcccgc

SEQ ID NO: 5103 - DNA, 23 bp, Artificial Sequence
  Description of Artificial Sequence: Synthetic oligonucleotide
agggactcctcgaggagtccctc

SEQ ID NO: 5104 - DNA, 23 bp, Artificial Sequence
  Description of Artificial Sequence: Synthetic oligonucleotide
tgggactcctcgaggagtcccac

SEQ ID NO: 5105 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccaattggagtcnnnn

SEQ ID NO: 5106 - DNA, 23 bp, Artificial Sequence
  Description of Artificial Sequence: Synthetic oligonucleotide
gcggactccaattggagtccgcc

SEQ ID NO: 5107 - DNA, 23 bp, Artificial Sequence
  Description of Artificial Sequence: Synthetic oligonucleotide
gcggactccaattggagtccgct

SEQ ID NO: 5108 - DNA, 23 bp, Artificial Sequence
  Description of Artificial Sequence: Synthetic oligonucleotide
acggactccaattggagtccgtc

SEQ ID NO: 5109 - DNA, 23 bp, Artificial Sequence
  Description of Artificial Sequence: Synthetic oligonucleotide
gaggactccaattggagtcctcc

SEQ ID NO: 5110 - DNA, 23 bp, Artificial Sequence
  Description of Artificial Sequence: Synthetic oligonucleotide
gcagactccaattggagtctgcc

SEQ ID NO: 5111 - DNA, 23 bp, Artificial Sequence
  Description of Artificial Sequence: Synthetic oligonucleotide
gcggactccaattggagtccgca

SEQ ID NO: 5112 - DNA, 23 bp, Artificial Sequence
  Description of Artificial Sequence: Synthetic oligonucleotide
tcggactccaattggagtccgac

SEQ ID NO: 5113 - DNA, 23 bp, Artificial Sequence
  Description of Artificial Sequence: Synthetic oligonucleotide
gtggactccaattggagtccacc

SEQ ID NO: 5114 - DNA, 23 bp, Artificial Sequence
  Description of Artificial Sequence: Synthetic oligonucleotide
gctgactccaattggagtcagcc

SEQ ID NO: 5115 - DNA, 23 bp, Artificial Sequence
  Description of Artificial Sequence: Synthetic oligonucleotide
cccgactccaattggagtcgggc

SEQ ID NO: 5116 - DNA, 23 bp, Artificial Sequence
  Description of Artificial Sequence: Synthetic oligonucleotide
cccgactccaattggagtcgggt

SEQ ID NO: 5117 - DNA, 23 bp, Artificial Sequence
  Description of Artificial Sequence: Synthetic oligonucleotide
accgactccaattggagtcggtc

SEQ ID NO: 5118 - DNA, 23 bp, Artificial Sequence
  Description of Artificial Sequence: Synthetic oligonucleotide
cacgactccaattggagtcgtgc

SEQ ID NO: 5119 - DNA, 23 bp, Artificial Sequence
  Description of Artificial Sequence: Synthetic oligonucleotide
ccagactccaattggagtctggc

SEQ ID NO: 5120 - DNA, 23 bp, Artificial Sequence
  Description of Artificial Sequence: Synthetic oligonucleotide
cccgactccaattggagtcggga

SEQ ID NO: 5121 - DNA, 23 bp, Artificial Sequence
  Description of Artificial Sequence: Synthetic oligonucleotide
tccgactccaattggagtcggac

SEQ ID NO: 5122 - DNA, 23 bp, Artificial Sequence
  Description of Artificial Sequence: Synthetic oligonucleotide
cctgactccaattggagtcaggc

SEQ ID NO: 5123 - DNA, 23 bp, Artificial Sequence
  Description of Artificial Sequence: Synthetic oligonucleotide
ggcgactccaattggagtcgccc

SEQ ID NO: 5124 - DNA, 23 bp, Artificial Sequence
  Description of Artificial Sequence: Synthetic oligonucleotide
ggcgactccaattggagtcgcct

SEQ ID NO: 5125 - DNA, 23 bp, Artificial Sequence
  Description of Artificial Sequence: Synthetic oligonucleotide
agcgactccaattggagtcgctc

SEQ ID NO: 5126 - DNA, 23 bp, Artificial Sequence
  Description of Artificial Sequence: Synthetic oligonucleotide
gacgactccaattggagtcgtcc

SEQ ID NO: 5127 - DNA, 23 bp, Artificial Sequence
  Description of Artificial Sequence: Synthetic oligonucleotide
ggagactccaattggagtctccc

SEQ ID NO: 5128 - DNA, 23 bp, Artificial Sequence
  Description of Artificial Sequence: Synthetic oligonucleotide
ggcgactccaattggagtcgcca

SEQ ID NO: 5129 - DNA, 23 bp, Artificial Sequence
  Description of Artificial Sequence: Synthetic oligonucleotide
tgcgactccaattggagtcgcac

SEQ ID NO: 5130 - DNA, 23 bp, Artificial Sequence
  Description of Artificial Sequence: Synthetic oligonucleotide
ggtgactccaattggagtcaccc

SEQ ID NO: 5131 - DNA, 23 bp, Artificial Sequence
  Description of Artificial Sequence: Synthetic oligonucleotide
cgggactccaattggagtcccgt

SEQ ID NO: 5132 - DNA, 23 bp, Artificial Sequence
  Description of Artificial Sequence: Synthetic oligonucleotide
agggactccaattggagtccctg

SEQ ID NO: 5133 - DNA, 23 bp, Artificial Sequence
  Description of Artificial Sequence: Synthetic oligonucleotide
caggactccaattggagtcctgg

SEQ ID NO: 5134 - DNA, 23 bp, Artificial Sequence
  Description of Artificial Sequence: Synthetic oligonucleotide
cgagactccaattggagtctcgg

SEQ ID NO: 5135 - DNA, 23 bp, Artificial Sequence
  Description of Artificial Sequence: Synthetic oligonucleotide
cgggactccaattggagtcccga

SEQ ID NO: 5136 - DNA, 23 bp, Artificial Sequence
  Description of Artificial Sequence: Synthetic oligonucleotide
tgggactccaattggagtcccag

SEQ ID NO: 5137 - DNA, 23 bp, Artificial Sequence
  Description of Artificial Sequence: Synthetic oligonucleotide
ctggactccaattggagtccagg

SEQ ID NO: 5138 - DNA, 23 bp, Artificial Sequence
  Description of Artificial Sequence: Synthetic oligonucleotide
cgtgactccaattggagtcacgg

SEQ ID NO: 5139 - DNA, 23 bp, Artificial Sequence
  Description of Artificial Sequence: Synthetic oligonucleotide
ggcgactccaattggagtcgccg

SEQ ID NO: 5140 - DNA, 23 bp, Artificial Sequence
  Description of Artificial Sequence: Synthetic oligonucleotide
agcgactccaattggagtcgctg

SEQ ID NO: 5141 - DNA, 23 bp, Artificial Sequence
  Description of Artificial Sequence: Synthetic oligonucleotide
gacgactccaattggagtcgtcg

SEQ ID NO: 5142 - DNA, 23 bp, Artificial Sequence
  Description of Artificial Sequence: Synthetic oligonucleotide
ggagactccaattggagtctccg

SEQ ID NO: 5143 - DNA, 23 bp, Artificial Sequence
  Description of Artificial Sequence: Synthetic oligonucleotide
tgcgactccaattggagtcgcag

SEQ ID NO: 5144 - DNA, 23 bp, Artificial Sequence
  Description of Artificial Sequence: Synthetic oligonucleotide
ggtgactccaattggagtcaccg

SEQ ID NO: 5145 - DNA, 23 bp, Artificial Sequence
  Description of Artificial Sequence: Synthetic oligonucleotide
acggactccaattggagtccgtg

SEQ ID NO: 5146 - DNA, 23 bp, Artificial Sequence
  Description of Artificial Sequence: Synthetic oligonucleotide
ccagactccaattggagtctggg

SEQ ID NO: 5147 - DNA, 23 bp, Artificial Sequence
  Description of Artificial Sequence: Synthetic oligonucleotide
tcggactccaattggagtccgag

SEQ ID NO: 5148 - DNA, 23 bp, Artificial Sequence
  Description of Artificial Sequence: Synthetic oligonucleotide
cctgactccaattggagtcaggg

SEQ ID NO: 5149 - DNA, 23 bp, Artificial Sequence
  Description of Artificial Sequence: Synthetic oligonucleotide
cacgactccaattggagtcgtgg

SEQ ID NO: 5150 - DNA, 23 bp, Artificial Sequence
  Description of Artificial Sequence: Synthetic oligonucleotide
gccgactccaattggagtcggct

SEQ ID NO: 5151 - DNA, 23 bp, Artificial Sequence
  Description of Artificial Sequence: Synthetic oligonucleotide
gccgactccaattggagtcggca

SEQ ID NO: 5152 - DNA, 23 bp, Artificial Sequence
  Description of Artificial Sequence: Synthetic oligonucleotide
cgagactccaattggagtctcgc

SEQ ID NO: 5153 - DNA, 23 bp, Artificial Sequence
  Description of Artificial Sequence: Synthetic oligonucleotide
cgtgactccaattggagtcacgc

SEQ ID NO: 5154 - DNA, 23 bp, Artificial Sequence
  Description of Artificial Sequence: Synthetic oligonucleotide
caggactccaattggagtcctgc

SEQ ID NO: 5155 - DNA, 23 bp, Artificial Sequence
  Description of Artificial Sequence: Synthetic oligonucleotide
ctggactccaattggagtccagc

SEQ ID NO: 5156 - DNA, 23 bp, Artificial Sequence
  Description of Artificial Sequence: Synthetic oligonucleotide
gaggactccaattggagtcctcg

SEQ ID NO: 5157 - DNA, 23 bp, Artificial Sequence
  Description of Artificial Sequence: Synthetic oligonucleotide
gtggactccaattggagtccacg

SEQ ID NO: 5158 - DNA, 23 bp, Artificial Sequence
  Description of Artificial Sequence: Synthetic oligonucleotide
accgactccaattggagtcggtg

SEQ ID NO: 5159 - DNA, 23 bp, Artificial Sequence
  Description of Artificial Sequence: Synthetic oligonucleotide
tccgactccaattggagtcggag

SEQ ID NO: 5160 - DNA, 23 bp, Artificial Sequence
  Description of Artificial Sequence: Synthetic oligonucleotide
cgggactccaattggagtcccgc

SEQ ID NO: 5161 - DNA, 23 bp, Artificial Sequence
  Description of Artificial Sequence: Synthetic oligonucleotide
agggactccaattggagtccctc

SEQ ID NO: 5162 - DNA, 23 bp, Artificial Sequence
  Description of Artificial Sequence: Synthetic oligonucleotide
tgggactccaattggagtcccac

SEQ ID NO: 5163 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccatatggagtcnnnn

SEQ ID NO: 5164 - DNA, 23 bp, Artificial Sequence
  Description of Artificial Sequence: Synthetic oligonucleotide
gcggactccatatggagtccgcc

SEQ ID NO: 5165 - DNA, 23 bp, Artificial Sequence
  Description of Artificial Sequence: Synthetic oligonucleotide
gcggactccatatggagtccgct

SEQ ID NO: 5166 - DNA, 23 bp, Artificial Sequence
  Description of Artificial Sequence: Synthetic oligonucleotide
acggactccatatggagtccgtc

SEQ ID NO: 5167 - DNA, 23 bp, Artificial Sequence
  Description of Artificial Sequence: Synthetic oligonucleotide
gaggactccatatggagtcctcc

SEQ ID NO: 5168 - DNA, 23 bp, Artificial Sequence
  Description of Artificial Sequence: Synthetic oligonucleotide
gcagactccatatggagtctgcc

SEQ ID NO: 5169 - DNA, 23 bp, Artificial Sequence
  Description of Artificial Sequence: Synthetic oligonucleotide
gcggactccatatggagtccgca

SEQ ID NO: 5170 - DNA, 23 bp, Artificial Sequence
  Description of Artificial Sequence: Synthetic oligonucleotide
tcggactccatatggagtccgac

SEQ ID NO: 5171 - DNA, 23 bp, Artificial Sequence
  Description of Artificial Sequence: Synthetic oligonucleotide
gtggactccatatggagtccacc

SEQ ID NO: 5172 - DNA, 23 bp, Artificial Sequence
  Description of Artificial Sequence: Synthetic oligonucleotide
gctgactccatatggagtcagcc

SEQ ID NO: 5173 - DNA, 23 bp, Artificial Sequence
  Description of Artificial Sequence: Synthetic oligonucleotide
cccgactccatatggagtcgggc

SEQ ID NO: 5174 - DNA, 23 bp, Artificial Sequence
  Description of Artificial Sequence: Synthetic oligonucleotide
cccgactccatatggagtcgggt

SEQ ID NO: 5175 - DNA, 23 bp, Artificial Sequence
  Description of Artificial Sequence: Synthetic oligonucleotide
accgactccatatggagtcggtc

SEQ ID NO: 5176 - DNA, 23 bp, Artificial Sequence
  Description of Artificial Sequence: Synthetic oligonucleotide
cacgactccatatggagtcgtgc

SEQ ID NO: 5177 - DNA, 23 bp, Artificial Sequence
  Description of Artificial Sequence: Synthetic oligonucleotide
ccagactccatatggagtctggc

SEQ ID NO: 5178 - DNA, 23 bp, Artificial Sequence
  Description of Artificial Sequence: Synthetic oligonucleotide
cccgactccatatggagtcggga

SEQ ID NO: 5179 - DNA, 23 bp, Artificial Sequence
  Description of Artificial Sequence: Synthetic oligonucleotide
tccgactccatatggagtcggac

SEQ ID NO: 5180 - DNA, 23 bp, Artificial Sequence
  Description of Artificial Sequence: Synthetic oligonucleotide
cctgactccatatggagtcaggc

SEQ ID NO: 5181 - DNA, 23 bp, Artificial Sequence
  Description of Artificial Sequence: Synthetic oligonucleotide
ggcgactccatatggagtcgccc

SEQ ID NO: 5182 - DNA, 23 bp, Artificial Sequence
  Description of Artificial Sequence: Synthetic oligonucleotide
ggcgactccatatggagtcgcct

SEQ ID NO: 5183 - DNA, 23 bp, Artificial Sequence
  Description of Artificial Sequence: Synthetic oligonucleotide
agcgactccatatggagtcgctc

SEQ ID NO: 5184 - DNA, 23 bp, Artificial Sequence
  Description of Artificial Sequence: Synthetic oligonucleotide
gacgactccatatggagtcgtcc

SEQ ID NO: 5185 - DNA, 23 bp, Artificial Sequence
  Description of Artificial Sequence: Synthetic oligonucleotide
ggagactccatatggagtctccc

SEQ ID NO: 5186 - DNA, 23 bp, Artificial Sequence
  Description of Artificial Sequence: Synthetic oligonucleotide
ggcgactccatatggagtcgcca

SEQ ID NO: 5187 - DNA, 23 bp, Artificial Sequence
  Description of Artificial Sequence: Synthetic oligonucleotide
tgcgactccatatggagtcgcac

SEQ ID NO: 5188 - DNA, 23 bp, Artificial Sequence
  Description of Artificial Sequence: Synthetic oligonucleotide
ggtgactccatatggagtcaccc

SEQ ID NO: 5189 - DNA, 23 bp, Artificial Sequence
  Description of Artificial Sequence: Synthetic oligonucleotide
cgggactccatatggagtcccgt

SEQ ID NO: 5190 - DNA, 23 bp, Artificial Sequence
  Description of Artificial Sequence: Synthetic oligonucleotide
agggactccatatggagtccctg

SEQ ID NO: 5191 - DNA, 23 bp, Artificial Sequence
  Description of Artificial Sequence: Synthetic oligonucleotide
caggactccatatggagtcctgg

SEQ ID NO: 5192 - DNA, 23 bp, Artificial Sequence
  Description of Artificial Sequence: Synthetic oligonucleotide
cgagactccatatggagtctcgg

SEQ ID NO: 5193 - DNA, 23 bp, Artificial Sequence
  Description of Artificial Sequence: Synthetic oligonucleotide
cgggactccatatggagtcccga

SEQ ID NO: 5194 - DNA, 23 bp, Artificial Sequence
  Description of Artificial Sequence: Synthetic oligonucleotide
tgggactccatatggagtcccag

SEQ ID NO: 5195 - DNA, 23 bp, Artificial Sequence
  Description of Artificial Sequence: Synthetic oligonucleotide
ctggactccatatggagtccagg

SEQ ID NO: 5196 - DNA, 23 bp, Artificial Sequence
  Description of Artificial Sequence: Synthetic oligonucleotide
cgtgactccatatggagtcacgg

SEQ ID NO: 5197 - DNA, 23 bp, Artificial Sequence
  Description of Artificial Sequence: Synthetic oligonucleotide
ggcgactccatatggagtcgccg

SEQ ID NO: 5198 - DNA, 23 bp, Artificial Sequence
  Description of Artificial Sequence: Synthetic oligonucleotide
agcgactccatatggagtcgctg

SEQ ID NO: 5199 - DNA, 23 bp, Artificial Sequence
  Description of Artificial Sequence: Synthetic oligonucleotide
gacgactccatatggagtcgtcg

SEQ ID NO: 5200 - DNA, 23 bp, Artificial Sequence
  Description of Artificial Sequence: Synthetic oligonucleotide
ggagactccatatggagtctccg

SEQ ID NO: 5201 - DNA, 23 bp, Artificial Sequence
  Description of Artificial Sequence: Synthetic oligonucleotide
tgcgactccatatggagtcgcag

SEQ ID NO: 5202 - DNA, 23 bp, Artificial Sequence
  Description of Artificial Sequence: Synthetic oligonucleotide
ggtgactccatatggagtcaccg

SEQ ID NO: 5203 - DNA, 23 bp, Artificial Sequence
  Description of Artificial Sequence: Synthetic oligonucleotide
acggactccatatggagtccgtg

SEQ ID NO: 5204 - DNA, 23 bp, Artificial Sequence
  Description of Artificial Sequence: Synthetic oligonucleotide
ccagactccatatggagtctggg

SEQ ID NO: 5205 - DNA, 23 bp, Artificial Sequence
  Description of Artificial Sequence: Synthetic oligonucleotide
tcggactccatatggagtccgag

SEQ ID NO: 5206 - DNA, 23 bp, Artificial Sequence
  Description of Artificial Sequence: Synthetic oligonucleotide
cctgactccatatggagtcaggg

SEQ ID NO: 5207 - DNA, 23 bp, Artificial Sequence
  Description of Artificial Sequence: Synthetic oligonucleotide
cacgactccatatggagtcgtgg

SEQ ID NO: 5208 - DNA, 23 bp, Artificial Sequence
  Description of Artificial Sequence: Synthetic oligonucleotide
gccgactccatatggagtcggct

SEQ ID NO: 5209 - DNA, 23 bp, Artificial Sequence
  Description of Artificial Sequence: Synthetic oligonucleotide
gccgactccatatggagtcggca

SEQ ID NO: 5210 - DNA, 23 bp, Artificial Sequence
  Description of Artificial Sequence: Synthetic oligonucleotide
cgagactccatatggagtctcgc

SEQ ID NO: 5211 - DNA, 23 bp, Artificial Sequence
  Description of Artificial Sequence: Synthetic oligonucleotide
cgtgactccatatggagtcacgc

SEQ ID NO: 5212 - DNA, 23 bp, Artificial Sequence
  Description of Artificial Sequence: Synthetic oligonucleotide
caggactccatatggagtcctgc

SEQ ID NO: 5213 - DNA, 23 bp, Artificial Sequence
  Description of Artificial Sequence: Synthetic oligonucleotide
ctggactccatatggagtccagc

SEQ ID NO: 5214 - DNA, 23 bp, Artificial Sequence
  Description of Artificial Sequence: Synthetic oligonucleotide
gaggactccatatggagtcctcg

SEQ ID NO: 5215 - DNA, 23 bp, Artificial Sequence
  Description of Artificial Sequence: Synthetic oligonucleotide
gtggactccatatggagtccacg

SEQ ID NO: 5216 - DNA, 23 bp, Artificial Sequence
  Description of Artificial Sequence: Synthetic oligonucleotide
accgactccatatggagtcggtg

SEQ ID NO: 5217 - DNA, 23 bp, Artificial Sequence
  Description of Artificial Sequence: Synthetic oligonucleotide
tccgactccatatggagtcggag

SEQ ID NO: 5218 - DNA, 23 bp, Artificial Sequence
  Description of Artificial Sequence: Synthetic oligonucleotide
cgggactccatatggagtcccgc

SEQ ID NO: 5219 - DNA, 23 bp, Artificial Sequence
  Description of Artificial Sequence: Synthetic oligonucleotide
agggactccatatggagtccctc

SEQ ID NO: 5220 - DNA, 23 bp, Artificial Sequence
  Description of Artificial Sequence: Synthetic oligonucleotide
tgggactccatatggagtcccac

SEQ ID NO: 5221 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccagctggagtcnnnn

SEQ ID NO: 5222 - DNA, 23 bp, Artificial Sequence
  Description of Artificial Sequence: Synthetic oligonucleotide
gcggactccagctggagtccgcc

SEQ ID NO: 5223 - DNA, 23 bp, Artificial Sequence
  Description of Artificial Sequence: Synthetic oligonucleotide
gcggactccagctggagtccgct

SEQ ID NO: 5224 - DNA, 23 bp, Artificial Sequence
  Description of Artificial Sequence: Synthetic oligonucleotide
acggactccagctggagtccgtc

SEQ ID NO: 5225 - DNA, 23 bp, Artificial Sequence
  Description of Artificial Sequence: Synthetic oligonucleotide
gaggactccagctggagtcctcc

SEQ ID NO: 5226 - DNA, 23 bp, Artificial Sequence
  Description of Artificial Sequence: Synthetic oligonucleotide
gcagactccagctggagtctgcc

SEQ ID NO: 5227 - DNA, 23 bp, Artificial Sequence
  Description of Artificial Sequence: Synthetic oligonucleotide
gcggactccagctggagtccgca

SEQ ID NO: 5228 - DNA, 23 bp, Artificial Sequence
  Description of Artificial Sequence: Synthetic oligonucleotide
tcggactccagctggagtccgac

SEQ ID NO: 5229 - DNA, 23 bp, Artificial Sequence
  Description of Artificial Sequence: Synthetic oligonucleotide
gtggactccagctggagtccacc

SEQ ID NO: 5230 - DNA, 23 bp, Artificial Sequence
  Description of Artificial Sequence: Synthetic oligonucleotide
gctgactccagctggagtcagcc

SEQ ID NO: 5231 - DNA, 23 bp, Artificial Sequence
  Description of Artificial Sequence: Synthetic oligonucleotide
cccgactccagctggagtcgggc

SEQ ID NO: 5232 - DNA, 23 bp, Artificial Sequence
  Description of Artificial Sequence: Synthetic oligonucleotide
cccgactccagctggagtcgggt

SEQ ID NO: 5233 - DNA, 23 bp, Artificial Sequence
  Description of Artificial Sequence: Synthetic oligonucleotide
accgactccagctggagtcggtc

SEQ ID NO: 5234 - DNA, 23 bp, Artificial Sequence
  Description of Artificial Sequence: Synthetic oligonucleotide
cacgactccagctggagtcgtgc

SEQ ID NO: 5235 - DNA, 23 bp, Artificial Sequence
  Description of Artificial Sequence: Synthetic oligonucleotide
ccagactccagctggagtctggc

SEQ ID NO: 5236 - DNA, 23 bp, Artificial Sequence
  Description of Artificial Sequence: Synthetic oligonucleotide
cccgactccagctggagtcggga

SEQ ID NO: 5237 - DNA, 23 bp, Artificial Sequence
  Description of Artificial Sequence: Synthetic oligonucleotide
tccgactccagctggagtcggac

SEQ ID NO: 5238 - DNA, 23 bp, Artificial Sequence
  Description of Artificial Sequence: Synthetic oligonucleotide
cctgactccagctggagtcaggc

SEQ ID NO: 5239 - DNA, 23 bp, Artificial Sequence
  Description of Artificial Sequence: Synthetic oligonucleotide
ggcgactccagctggagtcgccc

SEQ ID NO: 5240 - DNA, 23 bp, Artificial Sequence
  Description of Artificial Sequence: Synthetic oligonucleotide
ggcgactccagctggagtcgcct

SEQ ID NO: 5241 - DNA, 23 bp, Artificial Sequence
  Description of Artificial Sequence: Synthetic oligonucleotide
agcgactccagctggagtcgctc

SEQ ID NO: 5242 - DNA, 23 bp, Artificial Sequence
  Description of Artificial Sequence: Synthetic oligonucleotide
gacgactccagctggagtcgtcc

SEQ ID NO: 5243 - DNA, 23 bp, Artificial Sequence
  Description of Artificial Sequence: Synthetic oligonucleotide
ggagactccagctggagtctccc

SEQ ID NO: 5244 - DNA, 23 bp, Artificial Sequence
  Description of Artificial Sequence: Synthetic oligonucleotide
ggcgactccagctggagtcgcca

SEQ ID NO: 5245 - DNA, 23 bp, Artificial Sequence
  Description of Artificial Sequence: Synthetic oligonucleotide
tgcgactccagctggagtcgcac

SEQ ID NO: 5246 - DNA, 23 bp, Artificial Sequence
  Description of Artificial Sequence: Synthetic oligonucleotide
ggtgactccagctggagtcaccc

SEQ ID NO: 5247 - DNA, 23 bp, Artificial Sequence
  Description of Artificial Sequence: Synthetic oligonucleotide
cgggactccagctggagtcccgt

SEQ ID NO: 5248 - DNA, 23 bp, Artificial Sequence
  Description of Artificial Sequence: Synthetic oligonucleotide
agggactccagctggagtccctg

SEQ ID NO: 5249 - DNA, 23 bp, Artificial Sequence
  Description of Artificial Sequence: Synthetic oligonucleotide
caggactccagctggagtcctgg

SEQ ID NO: 5250 - DNA, 23 bp, Artificial Sequence
  Description of Artificial Sequence: Synthetic oligonucleotide
cgagactccagctggagtctcgg

SEQ ID NO: 5251 - DNA, 23 bp, Artificial Sequence
  Description of Artificial Sequence: Synthetic oligonucleotide
cgggactccagctggagtcccga

SEQ ID NO: 5252 - DNA, 23 bp, Artificial Sequence
  Description of Artificial Sequence: Synthetic oligonucleotide
tgggactccagctggagtcccag

SEQ ID NO: 5253 - DNA, 23 bp, Artificial Sequence
  Description of Artificial Sequence: Synthetic oligonucleotide
ctggactccagctggagtccagg

SEQ ID NO: 5254 - DNA, 23 bp, Artificial Sequence
  Description of Artificial Sequence: Synthetic oligonucleotide
cgtgactccagctggagtcacgg

SEQ ID NO: 5255 - DNA, 23 bp, Artificial Sequence
  Description of Artificial Sequence: Synthetic oligonucleotide
ggcgactccagctggagtcgccg

SEQ ID NO: 5256 - DNA, 23 bp, Artificial Sequence
  Description of Artificial Sequence: Synthetic oligonucleotide
agcgactccagctggagtcgctg

SEQ ID NO: 5257 - DNA, 23 bp, Artificial Sequence
  Description of Artificial Sequence: Synthetic oligonucleotide
gacgactccagctggagtcgtcg

SEQ ID NO: 5258 - DNA, 23 bp, Artificial Sequence
  Description of Artificial Sequence: Synthetic oligonucleotide
ggagactccagctggagtctccg

SEQ ID NO: 5259 - DNA, 23 bp, Artificial Sequence
  Description of Artificial Sequence: Synthetic oligonucleotide
tgcgactccagctggagtcgcag

SEQ ID NO: 5260 - DNA, 23 bp, Artificial Sequence
  Description of Artificial Sequence: Synthetic oligonucleotide
ggtgactccagctggagtcaccg

SEQ ID NO: 5261 - DNA, 23 bp, Artificial Sequence
  Description of Artificial Sequence: Synthetic oligonucleotide
acggactccagctggagtccgtg

SEQ ID NO: 5262 - DNA, 23 bp, Artificial Sequence
  Description of Artificial Sequence: Synthetic oligonucleotide
ccagactccagctggagtctggg

SEQ ID NO: 5263 - DNA, 23 bp, Artificial Sequence
  Description of Artificial Sequence: Synthetic oligonucleotide
tcggactccagctggagtccgag

SEQ ID NO: 5264 - DNA, 23 bp, Artificial Sequence
  Description of Artificial Sequence: Synthetic oligonucleotide
cctgactccagctggagtcaggg

SEQ ID NO: 5265 - DNA, 23 bp, Artificial Sequence
  Description of Artificial Sequence: Synthetic oligonucleotide
cacgactccagctggagtcgtgg

SEQ ID NO: 5266 - DNA, 23 bp, Artificial Sequence
  Description of Artificial Sequence: Synthetic oligonucleotide
gccgactccagctggagtcggct

SEQ ID NO: 5267 - DNA, 23 bp, Artificial Sequence
  Description of Artificial Sequence: Synthetic oligonucleotide
gccgactccagctggagtcggca

SEQ ID NO: 5268 - DNA, 23 bp, Artificial Sequence
  Description of Artificial Sequence: Synthetic oligonucleotide
cgagactccagctggagtctcgc

SEQ ID NO: 5269 - DNA, 23 bp, Artificial Sequence
  Description of Artificial Sequence: Synthetic oligonucleotide
cgtgactccagctggagtcacgc

SEQ ID NO: 5270 - DNA, 23 bp, Artificial Sequence
  Description of Artificial Sequence: Synthetic oligonucleotide
caggactccagctggagtcctgc

SEQ ID NO: 5271 - DNA, 23 bp, Artificial Sequence
  Description of Artificial Sequence: Synthetic oligonucleotide
ctggactccagctggagtccagc

SEQ ID NO: 5272 - DNA, 23 bp, Artificial Sequence
  Description of Artificial Sequence: Synthetic oligonucleotide
gaggactccagctggagtcctcg

SEQ ID NO: 5273 - DNA, 23 bp, Artificial Sequence
  Description of Artificial Sequence: Synthetic oligonucleotide
gtggactccagctggagtccacg

SEQ ID NO: 5274 - DNA, 23 bp, Artificial Sequence
  Description of Artificial Sequence: Synthetic oligonucleotide
accgactccagctggagtcggtg

SEQ ID NO: 5275 - DNA, 23 bp, Artificial Sequence
  Description of Artificial Sequence: Synthetic oligonucleotide
tccgactccagctggagtcggag

SEQ ID NO: 5276 - DNA, 23 bp, Artificial Sequence
  Description of Artificial Sequence: Synthetic oligonucleotide
cgggactccagctggagtcccgc

SEQ ID NO: 5277 - DNA, 23 bp, Artificial Sequence
  Description of Artificial Sequence: Synthetic oligonucleotide
agggactccagctggagtccctc

SEQ ID NO: 5278 - DNA, 23 bp, Artificial Sequence
  Description of Artificial Sequence: Synthetic oligonucleotide
tgggactccagctggagtcccac

SEQ ID NO: 5279 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactccacgtggagtcnnnn

SEQ ID NO: 5280 - DNA, 23 bp, Artificial Sequence
  Description of Artificial Sequence: Synthetic oligonucleotide
gcggactccacgtggagtccgcc

SEQ ID NO: 5281 - DNA, 23 bp, Artificial Sequence
  Description of Artificial Sequence: Synthetic oligonucleotide
gcggactccacgtggagtccgct

SEQ ID NO: 5282 - DNA, 23 bp, Artificial Sequence
  Description of Artificial Sequence: Synthetic oligonucleotide
acggactccacgtggagtccgtc

SEQ ID NO: 5283 - DNA, 23 bp, Artificial Sequence
  Description of Artificial Sequence: Synthetic oligonucleotide
gaggactccacgtggagtcctcc

SEQ ID NO: 5284 - DNA, 23 bp, Artificial Sequence
  Description of Artificial Sequence: Synthetic oligonucleotide
gcagactccacgtggagtctgcc

SEQ ID NO: 5285 - DNA, 23 bp, Artificial Sequence
  Description of Artificial Sequence: Synthetic oligonucleotide
gcggactccacgtggagtccgca

SEQ ID NO: 5286 - DNA, 23 bp, Artificial Sequence
  Description of Artificial Sequence: Synthetic oligonucleotide
tcggactccacgtggagtccgac

SEQ ID NO: 5287 - DNA, 23 bp, Artificial Sequence
  Description of Artificial Sequence: Synthetic oligonucleotide
gtggactccacgtggagtccacc

SEQ ID NO: 5288 - DNA, 23 bp, Artificial Sequence
  Description of Artificial Sequence: Synthetic oligonucleotide
gctgactccacgtggagtcagcc

SEQ ID NO: 5289 - DNA, 23 bp, Artificial Sequence
  Description of Artificial Sequence: Synthetic oligonucleotide
cccgactccacgtggagtcgggc

SEQ ID NO: 5290 - DNA, 23 bp, Artificial Sequence
  Description of Artificial Sequence: Synthetic oligonucleotide
cccgactccacgtggagtcgggt

SEQ ID NO: 5291 - DNA, 23 bp, Artificial Sequence
  Description of Artificial Sequence: Synthetic oligonucleotide
accgactccacgtggagtcggtc

SEQ ID NO: 5292 - DNA, 23 bp, Artificial Sequence
  Description of Artificial Sequence: Synthetic oligonucleotide
cacgactccacgtggagtcgtgc

SEQ ID NO: 5293 - DNA, 23 bp, Artificial Sequence
  Description of Artificial Sequence: Synthetic oligonucleotide
ccagactccacgtggagtctggc

SEQ ID NO: 5294 - DNA, 23 bp, Artificial Sequence
  Description of Artificial Sequence: Synthetic oligonucleotide
cccgactccacgtggagtcggga

SEQ ID NO: 5295 - DNA, 23 bp, Artificial Sequence
  Description of Artificial Sequence: Synthetic oligonucleotide
tccgactccacgtggagtcggac

SEQ ID NO: 5296 - DNA, 23 bp, Artificial Sequence
  Description of Artificial Sequence: Synthetic oligonucleotide
cctgactccacgtggagtcaggc

SEQ ID NO: 5297 - DNA, 23 bp, Artificial Sequence
  Description of Artificial Sequence: Synthetic oligonucleotide
ggcgactccacgtggagtcgccc

SEQ ID NO: 5298 - DNA, 23 bp, Artificial Sequence
  Description of Artificial Sequence: Synthetic oligonucleotide
ggcgactccacgtggagtcgcct

SEQ ID NO: 5299 - DNA, 23 bp, Artificial Sequence
  Description of Artificial Sequence: Synthetic oligonucleotide
agcgactccacgtggagtcgctc

SEQ ID NO: 5300 - DNA, 23 bp, Artificial Sequence
  Description of Artificial Sequence: Synthetic oligonucleotide
gacgactccacgtggagtcgtcc

SEQ ID NO: 5301 - DNA, 23 bp, Artificial Sequence
  Description of Artificial Sequence: Synthetic oligonucleotide
ggagactccacgtggagtctccc

SEQ ID NO: 5302 - DNA, 23 bp, Artificial Sequence
  Description of Artificial Sequence: Synthetic oligonucleotide
ggcgactccacgtggagtcgcca

SEQ ID NO: 5303 - DNA, 23 bp, Artificial Sequence
  Description of Artificial Sequence: Synthetic oligonucleotide
tgcgactccacgtggagtcgcac

SEQ ID NO: 5304 - DNA, 23 bp, Artificial Sequence
  Description of Artificial Sequence: Synthetic oligonucleotide
ggtgactccacgtggagtcaccc

SEQ ID NO: 5305 - DNA, 23 bp, Artificial Sequence
  Description of Artificial Sequence: Synthetic oligonucleotide
cgggactccacgtggagtcccgt

SEQ ID NO: 5306 - DNA, 23 bp, Artificial Sequence
  Description of Artificial Sequence: Synthetic oligonucleotide
agggactccacgtggagtccctg

SEQ ID NO: 5307 - DNA, 23 bp, Artificial Sequence
  Description of Artificial Sequence: Synthetic oligonucleotide
caggactccacgtggagtcctgg

SEQ ID NO: 5308 - DNA, 23 bp, Artificial Sequence
  Description of Artificial Sequence: Synthetic oligonucleotide
cgagactccacgtggagtctcgg

SEQ ID NO: 5309 - DNA, 23 bp, Artificial Sequence
  Description of Artificial Sequence: Synthetic oligonucleotide
cgggactccacgtggagtcccga

SEQ ID NO: 5310 - DNA, 23 bp, Artificial Sequence
  Description of Artificial Sequence: Synthetic oligonucleotide
tgggactccacgtggagtcccag

SEQ ID NO: 5311 - DNA, 23 bp, Artificial Sequence
  Description of Artificial Sequence: Synthetic oligonucleotide
ctggactccacgtggagtccagg

SEQ ID NO: 5312 - DNA, 23 bp, Artificial Sequence
  Description of Artificial Sequence: Synthetic oligonucleotide
cgtgactccacgtggagtcacgg

SEQ ID NO: 5313 - DNA, 23 bp, Artificial Sequence
  Description of Artificial Sequence: Synthetic oligonucleotide
ggcgactccacgtggagtcgccg

SEQ ID NO: 5314 - DNA, 23 bp, Artificial Sequence
  Description of Artificial Sequence: Synthetic oligonucleotide
agcgactccacgtggagtcgctg

SEQ ID NO: 5315 - DNA, 23 bp, Artificial Sequence
  Description of Artificial Sequence: Synthetic oligonucleotide
gacgactccacgtggagtcgtcg

SEQ ID NO: 5316 - DNA, 23 bp, Artificial Sequence
  Description of Artificial Sequence: Synthetic oligonucleotide
ggagactccacgtggagtctccg

SEQ ID NO: 5317 - DNA, 23 bp, Artificial Sequence
  Description of Artificial Sequence: Synthetic oligonucleotide
tgcgactccacgtggagtcgcag

SEQ ID NO: 5318 - DNA, 23 bp, Artificial Sequence
  Description of Artificial Sequence: Synthetic oligonucleotide
ggtgactccacgtggagtcaccg

SEQ ID NO: 5319 - DNA, 23 bp, Artificial Sequence
  Description of Artificial Sequence: Synthetic oligonucleotide
acggactccacgtggagtccgtg

SEQ ID NO: 5320 - DNA, 23 bp, Artificial Sequence
  Description of Artificial Sequence: Synthetic oligonucleotide
ccagactccacgtggagtctggg

SEQ ID NO: 5321 - DNA, 23 bp, Artificial Sequence
  Description of Artificial Sequence: Synthetic oligonucleotide
tcggactccacgtggagtccgag

SEQ ID NO: 5322 - DNA, 23 bp, Artificial Sequence
  Description of Artificial Sequence: Synthetic oligonucleotide
cctgactccacgtggagtcaggg

SEQ ID NO: 5323 - DNA, 23 bp, Artificial Sequence
  Description of Artificial Sequence: Synthetic oligonucleotide
cacgactccacgtggagtcgtgg

SEQ ID NO: 5324 - DNA, 23 bp, Artificial Sequence
  Description of Artificial Sequence: Synthetic oligonucleotide
gccgactccacgtggagtcggct

SEQ ID NO: 5325 - DNA, 23 bp, Artificial Sequence
  Description of Artificial Sequence: Synthetic oligonucleotide
gccgactccacgtggagtcggca

SEQ ID NO: 5326 - DNA, 23 bp, Artificial Sequence
  Description of Artificial Sequence: Synthetic oligonucleotide
cgagactccacgtggagtctcgc

SEQ ID NO: 5327 - DNA, 23 bp, Artificial Sequence
  Description of Artificial Sequence: Synthetic oligonucleotide
cgtgactccacgtggagtcacgc

SEQ ID NO: 5328 - DNA, 23 bp, Artificial Sequence
  Description of Artificial Sequence: Synthetic oligonucleotide
caggactccacgtggagtcctgc

SEQ ID NO: 5329 - DNA, 23 bp, Artificial Sequence
  Description of Artificial Sequence: Synthetic oligonucleotide
ctggactccacgtggagtccagc

SEQ ID NO: 5330 - DNA, 23 bp, Artificial Sequence
  Description of Artificial Sequence: Synthetic oligonucleotide
gaggactccacgtggagtcctcg

SEQ ID NO: 5331 - DNA, 23 bp, Artificial Sequence
  Description of Artificial Sequence: Synthetic oligonucleotide
gtggactccacgtggagtccacg

SEQ ID NO: 5332 - DNA, 23 bp, Artificial Sequence
  Description of Artificial Sequence: Synthetic oligonucleotide
accgactccacgtggagtcggtg

SEQ ID NO: 5333 - DNA, 23 bp, Artificial Sequence
  Description of Artificial Sequence: Synthetic oligonucleotide
tccgactccacgtggagtcggag

SEQ ID NO: 5334 - DNA, 23 bp, Artificial Sequence
  Description of Artificial Sequence: Synthetic oligonucleotide
cgggactccacgtggagtcccgc

SEQ ID NO: 5335 - DNA, 23 bp, Artificial Sequence
  Description of Artificial Sequence: Synthetic oligonucleotide
agggactccacgtggagtccctc

SEQ ID NO: 5336 - DNA, 23 bp, Artificial Sequence
  Description of Artificial Sequence: Synthetic oligonucleotide
tgggactccacgtggagtcccac

SEQ ID NO: 5337 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctcatgagagtcnnnn

SEQ ID NO: 5338 - DNA, 23 bp, Artificial Sequence
  Description of Artificial Sequence: Synthetic oligonucleotide
gcggactctcatgagagtccgcc

SEQ ID NO: 5339 - DNA, 23 bp, Artificial Sequence
  Description of Artificial Sequence: Synthetic oligonucleotide
gcggactctcatgagagtccgct

SEQ ID NO: 5340 - DNA, 23 bp, Artificial Sequence
  Description of Artificial Sequence: Synthetic oligonucleotide
acggactctcatgagagtccgtc

SEQ ID NO: 5341 - DNA, 23 bp, Artificial Sequence
  Description of Artificial Sequence: Synthetic oligonucleotide
gaggactctcatgagagtcctcc

SEQ ID NO: 5342 - DNA, 23 bp, Artificial Sequence
  Description of Artificial Sequence: Synthetic oligonucleotide
gcagactctcatgagagtctgcc

SEQ ID NO: 5343 - DNA, 23 bp, Artificial Sequence
  Description of Artificial Sequence: Synthetic oligonucleotide
gcggactctcatgagagtccgca

SEQ ID NO: 5344 - DNA, 23 bp, Artificial Sequence
  Description of Artificial Sequence: Synthetic oligonucleotide
tcggactctcatgagagtccgac

SEQ ID NO: 5345 - DNA, 23 bp, Artificial Sequence
  Description of Artificial Sequence: Synthetic oligonucleotide
gtggactctcatgagagtccacc

SEQ ID NO: 5346 - DNA, 23 bp, Artificial Sequence
  Description of Artificial Sequence: Synthetic oligonucleotide
gctgactctcatgagagtcagcc

SEQ ID NO: 5347 - DNA, 23 bp, Artificial Sequence
  Description of Artificial Sequence: Synthetic oligonucleotide
cccgactctcatgagagtcgggc

SEQ ID NO: 5348 - DNA, 23 bp, Artificial Sequence
  Description of Artificial Sequence: Synthetic oligonucleotide
cccgactctcatgagagtcgggt

SEQ ID NO: 5349 - DNA, 23 bp, Artificial Sequence
  Description of Artificial Sequence: Synthetic oligonucleotide
accgactctcatgagagtcggtc

SEQ ID NO: 5350 - DNA, 23 bp, Artificial Sequence
  Description of Artificial Sequence: Synthetic oligonucleotide
cacgactctcatgagagtcgtgc

SEQ ID NO: 5351 - DNA, 23 bp, Artificial Sequence
  Description of Artificial Sequence: Synthetic oligonucleotide
ccagactctcatgagagtctggc

SEQ ID NO: 5352 - DNA, 23 bp, Artificial Sequence
  Description of Artificial Sequence: Synthetic oligonucleotide
cccgactctcatgagagtcggga

SEQ ID NO: 5353 - DNA, 23 bp, Artificial Sequence
  Description of Artificial Sequence: Synthetic oligonucleotide
tccgactctcatgagagtcggac

SEQ ID NO: 5354 - DNA, 23 bp, Artificial Sequence
  Description of Artificial Sequence: Synthetic oligonucleotide
cctgactctcatgagagtcaggc

SEQ ID NO: 5355 - DNA, 23 bp, Artificial Sequence
  Description of Artificial Sequence: Synthetic oligonucleotide
ggcgactctcatgagagtcgccc

SEQ ID NO: 5356 - DNA, 23 bp, Artificial Sequence
  Description of Artificial Sequence: Synthetic oligonucleotide
ggcgactctcatgagagtcgcct

SEQ ID NO: 5357 - DNA, 23 bp, Artificial Sequence
  Description of Artificial Sequence: Synthetic oligonucleotide
agcgactctcatgagagtcgctc

SEQ ID NO: 5358 - DNA, 23 bp, Artificial Sequence
  Description of Artificial Sequence: Synthetic oligonucleotide
gacgactctcatgagagtcgtcc

SEQ ID NO: 5359 - DNA, 23 bp, Artificial Sequence
  Description of Artificial Sequence: Synthetic oligonucleotide
ggagactctcatgagagtctccc

SEQ ID NO: 5360 - DNA, 23 bp, Artificial Sequence
  Description of Artificial Sequence: Synthetic oligonucleotide
ggcgactctcatgagagtcgcca

SEQ ID NO: 5361 - DNA, 23 bp, Artificial Sequence
  Description of Artificial Sequence: Synthetic oligonucleotide
tgcgactctcatgagagtcgcac

SEQ ID NO: 5362 - DNA, 23 bp, Artificial Sequence
  Description of Artificial Sequence: Synthetic oligonucleotide
ggtgactctcatgagagtcaccc

SEQ ID NO: 5363 - DNA, 23 bp, Artificial Sequence
  Description of Artificial Sequence: Synthetic oligonucleotide
cgggactctcatgagagtcccgt

SEQ ID NO: 5364 - DNA, 23 bp, Artificial Sequence
  Description of Artificial Sequence: Synthetic oligonucleotide
agggactctcatgagagtccctg

SEQ ID NO: 5365 - DNA, 23 bp, Artificial Sequence
  Description of Artificial Sequence: Synthetic oligonucleotide
caggactctcatgagagtcctgg

SEQ ID NO: 5366 - DNA, 23 bp, Artificial Sequence
  Description of Artificial Sequence: Synthetic oligonucleotide
cgagactctcatgagagtctcgg

SEQ ID NO: 5367 - DNA, 23 bp, Artificial Sequence
  Description of Artificial Sequence: Synthetic oligonucleotide
cgggactctcatgagagtcccga

SEQ ID NO: 5368 - DNA, 23 bp, Artificial Sequence
  Description of Artificial Sequence: Synthetic oligonucleotide
tgggactctcatgagagtcccag

SEQ ID NO: 5369 - DNA, 23 bp, Artificial Sequence
  Description of Artificial Sequence: Synthetic oligonucleotide
ctggactctcatgagagtccagg

SEQ ID NO: 5370 - DNA, 23 bp, Artificial Sequence
  Description of Artificial Sequence: Synthetic oligonucleotide
cgtgactctcatgagagtcacgg

SEQ ID NO: 5371 - DNA, 23 bp, Artificial Sequence
  Description of Artificial Sequence: Synthetic oligonucleotide
ggcgactctcatgagagtcgccg

SEQ ID NO: 5372 - DNA, 23 bp, Artificial Sequence
  Description of Artificial Sequence: Synthetic oligonucleotide
agcgactctcatgagagtcgctg

SEQ ID NO: 5373 - DNA, 23 bp, Artificial Sequence
  Description of Artificial Sequence: Synthetic oligonucleotide
gacgactctcatgagagtcgtcg

SEQ ID NO: 5374 - DNA, 23 bp, Artificial Sequence
  Description of Artificial Sequence: Synthetic oligonucleotide
ggagactctcatgagagtctccg

SEQ ID NO: 5375 - DNA, 23 bp, Artificial Sequence
  Description of Artificial Sequence: Synthetic oligonucleotide
tgcgactctcatgagagtcgcag

SEQ ID NO: 5376 - DNA, 23 bp, Artificial Sequence
  Description of Artificial Sequence: Synthetic oligonucleotide
ggtgactctcatgagagtcaccg

SEQ ID NO: 5377 - DNA, 23 bp, Artificial Sequence
  Description of Artificial Sequence: Synthetic oligonucleotide
acggactctcatgagagtccgtg

SEQ ID NO: 5378 - DNA, 23 bp, Artificial Sequence
  Description of Artificial Sequence: Synthetic oligonucleotide
ccagactctcatgagagtctggg

SEQ ID NO: 5379 - DNA, 23 bp, Artificial Sequence
  Description of Artificial Sequence: Synthetic oligonucleotide
tcggactctcatgagagtccgag

SEQ ID NO: 5380 - DNA, 23 bp, Artificial Sequence
  Description of Artificial Sequence: Synthetic oligonucleotide
cctgactctcatgagagtcaggg

SEQ ID NO: 5381 - DNA, 23 bp, Artificial Sequence
  Description of Artificial Sequence: Synthetic oligonucleotide
cacgactctcatgagagtcgtgg

SEQ ID NO: 5382 - DNA, 23 bp, Artificial Sequence
  Description of Artificial Sequence: Synthetic oligonucleotide
gccgactctcatgagagtcggct

SEQ ID NO: 5383 - DNA, 23 bp, Artificial Sequence
  Description of Artificial Sequence: Synthetic oligonucleotide
gccgactctcatgagagtcggca

SEQ ID NO: 5384 - DNA, 23 bp, Artificial Sequence
  Description of Artificial Sequence: Synthetic oligonucleotide
cgagactctcatgagagtctcgc

SEQ ID NO: 5385 - DNA, 23 bp, Artificial Sequence
  Description of Artificial Sequence: Synthetic oligonucleotide
cgtgactctcatgagagtcacgc

SEQ ID NO: 5386 - DNA, 23 bp, Artificial Sequence
  Description of Artificial Sequence: Synthetic oligonucleotide
caggactctcatgagagtcctgc

SEQ ID NO: 5387 - DNA, 23 bp, Artificial Sequence
  Description of Artificial Sequence: Synthetic oligonucleotide
ctggactctcatgagagtccagc

SEQ ID NO: 5388 - DNA, 23 bp, Artificial Sequence
  Description of Artificial Sequence: Synthetic oligonucleotide
gaggactctcatgagagtcctcg

SEQ ID NO: 5389 - DNA, 23 bp, Artificial Sequence
  Description of Artificial Sequence: Synthetic oligonucleotide
gtggactctcatgagagtccacg

SEQ ID NO: 5390 - DNA, 23 bp, Artificial Sequence
  Description of Artificial Sequence: Synthetic oligonucleotide
accgactctcatgagagtcggtg

SEQ ID NO: 5391 - DNA, 23 bp, Artificial Sequence
  Description of Artificial Sequence: Synthetic oligonucleotide
tccgactctcatgagagtcggag

SEQ ID NO: 5392 - DNA, 23 bp, Artificial Sequence
  Description of Artificial Sequence: Synthetic oligonucleotide
cgggactctcatgagagtcccgc

SEQ ID NO: 5393 - DNA, 23 bp, Artificial Sequence
  Description of Artificial Sequence: Synthetic oligonucleotide
agggactctcatgagagtccctc

SEQ ID NO: 5394 - DNA, 23 bp, Artificial Sequence
  Description of Artificial Sequence: Synthetic oligonucleotide
tgggactctcatgagagtcccac

SEQ ID NO: 5395 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctctagagagtcnnnn

SEQ ID NO: 5396 - DNA, 23 bp, Artificial Sequence
  Description of Artificial Sequence: Synthetic oligonucleotide
gcggactctctagagagtccgcc

SEQ ID NO: 5397 - DNA, 23 bp, Artificial Sequence
  Description of Artificial Sequence: Synthetic oligonucleotide
gcggactctctagagagtccgct

SEQ ID NO: 5398 - DNA, 23 bp, Artificial Sequence
  Description of Artificial Sequence: Synthetic oligonucleotide
acggactctctagagagtccgtc

SEQ ID NO: 5399 - DNA, 23 bp, Artificial Sequence
  Description of Artificial Sequence: Synthetic oligonucleotide
gaggactctctagagagtcctcc

SEQ ID NO: 5400 - DNA, 23 bp, Artificial Sequence
  Description of Artificial Sequence: Synthetic oligonucleotide
gcagactctctagagagtctgcc

SEQ ID NO: 5401 - DNA, 23 bp, Artificial Sequence
  Description of Artificial Sequence: Synthetic oligonucleotide
gcggactctctagagagtccgca

SEQ ID NO: 5402 - DNA, 23 bp, Artificial Sequence
  Description of Artificial Sequence: Synthetic oligonucleotide
tcggactctctagagagtccgac

SEQ ID NO: 5403 - DNA, 23 bp, Artificial Sequence
  Description of Artificial Sequence: Synthetic oligonucleotide
gtggactctctagagagtccacc

SEQ ID NO: 5404 - DNA, 23 bp, Artificial Sequence
  Description of Artificial Sequence: Synthetic oligonucleotide
gctgactctctagagagtcagcc

SEQ ID NO: 5405 - DNA, 23 bp, Artificial Sequence
  Description of Artificial Sequence: Synthetic oligonucleotide
cccgactctctagagagtcgggc

SEQ ID NO: 5406 - DNA, 23 bp, Artificial Sequence
  Description of Artificial Sequence: Synthetic oligonucleotide
cccgactctctagagagtcgggt

SEQ ID NO: 5407 - DNA, 23 bp, Artificial Sequence
  Description of Artificial Sequence: Synthetic oligonucleotide
accgactctctagagagtcggtc

SEQ ID NO: 5408 - DNA, 23 bp, Artificial Sequence
  Description of Artificial Sequence: Synthetic oligonucleotide
cacgactctctagagagtcgtgc

SEQ ID NO: 5409 - DNA, 23 bp, Artificial Sequence
  Description of Artificial Sequence: Synthetic oligonucleotide
ccagactctctagagagtctggc

SEQ ID NO: 5410 - DNA, 23 bp, Artificial Sequence
  Description of Artificial Sequence: Synthetic oligonucleotide
cccgactctctagagagtcggga

SEQ ID NO: 5411 - DNA, 23 bp, Artificial Sequence
  Description of Artificial Sequence: Synthetic oligonucleotide
tccgactctctagagagtcggac

SEQ ID NO: 5412 - DNA, 23 bp, Artificial Sequence
  Description of Artificial Sequence: Synthetic oligonucleotide
cctgactctctagagagtcaggc

SEQ ID NO: 5413 - DNA, 23 bp, Artificial Sequence
  Description of Artificial Sequence: Synthetic oligonucleotide
ggcgactctctagagagtcgccc

SEQ ID NO: 5414 - DNA, 23 bp, Artificial Sequence
  Description of Artificial Sequence: Synthetic oligonucleotide
ggcgactctctagagagtcgcct

SEQ ID NO: 5415 - DNA, 23 bp, Artificial Sequence
  Description of Artificial Sequence: Synthetic oligonucleotide
agcgactctctagagagtcgctc

SEQ ID NO: 5416 - DNA, 23 bp, Artificial Sequence
  Description of Artificial Sequence: Synthetic oligonucleotide
gacgactctctagagagtcgtcc

SEQ ID NO: 5417 - DNA, 23 bp, Artificial Sequence
  Description of Artificial Sequence: Synthetic oligonucleotide
ggagactctctagagagtctccc

SEQ ID NO: 5418 - DNA, 23 bp, Artificial Sequence
  Description of Artificial Sequence: Synthetic oligonucleotide
ggcgactctctagagagtcgcca

SEQ ID NO: 5419 - DNA, 23 bp, Artificial Sequence
  Description of Artificial Sequence: Synthetic oligonucleotide
tgcgactctctagagagtcgcac

SEQ ID NO: 5420 - DNA, 23 bp, Artificial Sequence
  Description of Artificial Sequence: Synthetic oligonucleotide
ggtgactctctagagagtcaccc

SEQ ID NO: 5421 - DNA, 23 bp, Artificial Sequence
  Description of Artificial Sequence: Synthetic oligonucleotide
cgggactctctagagagtcccgt

SEQ ID NO: 5422 - DNA, 23 bp, Artificial Sequence
  Description of Artificial Sequence: Synthetic oligonucleotide
agggactctctagagagtccctg

SEQ ID NO: 5423 - DNA, 23 bp, Artificial Sequence
  Description of Artificial Sequence: Synthetic oligonucleotide
caggactctctagagagtcctgg

SEQ ID NO: 5424 - DNA, 23 bp, Artificial Sequence
  Description of Artificial Sequence: Synthetic oligonucleotide
cgagactctctagagagtctcgg

SEQ ID NO: 5425 - DNA, 23 bp, Artificial Sequence
  Description of Artificial Sequence: Synthetic oligonucleotide
cgggactctctagagagtcccga

SEQ ID NO: 5426 - DNA, 23 bp, Artificial Sequence
  Description of Artificial Sequence: Synthetic oligonucleotide
tgggactctctagagagtcccag

SEQ ID NO: 5427 - DNA, 23 bp, Artificial Sequence
  Description of Artificial Sequence: Synthetic oligonucleotide
ctggactctctagagagtccagg

SEQ ID NO: 5428 - DNA, 23 bp, Artificial Sequence
  Description of Artificial Sequence: Synthetic oligonucleotide
cgtgactctctagagagtcacgg

SEQ ID NO: 5429 - DNA, 23 bp, Artificial Sequence
  Description of Artificial Sequence: Synthetic oligonucleotide
ggcgactctctagagagtcgccg

SEQ ID NO: 5430 - DNA, 23 bp, Artificial Sequence
  Description of Artificial Sequence: Synthetic oligonucleotide
agcgactctctagagagtcgctg

SEQ ID NO: 5431 - DNA, 23 bp, Artificial Sequence
  Description of Artificial Sequence: Synthetic oligonucleotide
gacgactctctagagagtcgtcg

SEQ ID NO: 5432 - DNA, 23 bp, Artificial Sequence
  Description of Artificial Sequence: Synthetic oligonucleotide
ggagactctctagagagtctccg

SEQ ID NO: 5433 - DNA, 23 bp, Artificial Sequence
  Description of Artificial Sequence: Synthetic oligonucleotide
tgcgactctctagagagtcgcag

SEQ ID NO: 5434 - DNA, 23 bp, Artificial Sequence
  Description of Artificial Sequence: Synthetic oligonucleotide
ggtgactctctagagagtcaccg

SEQ ID NO: 5435 - DNA, 23 bp, Artificial Sequence
  Description of Artificial Sequence: Synthetic oligonucleotide
acggactctctagagagtccgtg

SEQ ID NO: 5436 - DNA, 23 bp, Artificial Sequence
  Description of Artificial Sequence: Synthetic oligonucleotide
ccagactctctagagagtctggg

SEQ ID NO: 5437 - DNA, 23 bp, Artificial Sequence
  Description of Artificial Sequence: Synthetic oligonucleotide
tcggactctctagagagtccgag

SEQ ID NO: 5438 - DNA, 23 bp, Artificial Sequence
  Description of Artificial Sequence: Synthetic oligonucleotide
cctgactctctagagagtcaggg

SEQ ID NO: 5439 - DNA, 23 bp, Artificial Sequence
  Description of Artificial Sequence: Synthetic oligonucleotide
cacgactctctagagagtcgtgg

SEQ ID NO: 5440 - DNA, 23 bp, Artificial Sequence
  Description of Artificial Sequence: Synthetic oligonucleotide
gccgactctctagagagtcggct

SEQ ID NO: 5441 - DNA, 23 bp, Artificial Sequence
  Description of Artificial Sequence: Synthetic oligonucleotide
gccgactctctagagagtcggca

SEQ ID NO: 5442 - DNA, 23 bp, Artificial Sequence
  Description of Artificial Sequence: Synthetic oligonucleotide
cgagactctctagagagtctcgc

SEQ ID NO: 5443 - DNA, 23 bp, Artificial Sequence
  Description of Artificial Sequence: Synthetic oligonucleotide
cgtgactctctagagagtcacgc

SEQ ID NO: 5444 - DNA, 23 bp, Artificial Sequence
  Description of Artificial Sequence: Synthetic oligonucleotide
caggactctctagagagtcctgc

SEQ ID NO: 5445 - DNA, 23 bp, Artificial Sequence
  Description of Artificial Sequence: Synthetic oligonucleotide
ctggactctctagagagtccagc

SEQ ID NO: 5446 - DNA, 23 bp, Artificial Sequence
  Description of Artificial Sequence: Synthetic oligonucleotide
gaggactctctagagagtcctcg

SEQ ID NO: 5447 - DNA, 23 bp, Artificial Sequence
  Description of Artificial Sequence: Synthetic oligonucleotide
gtggactctctagagagtccacg

SEQ ID NO: 5448 - DNA, 23 bp, Artificial Sequence
  Description of Artificial Sequence: Synthetic oligonucleotide
accgactctctagagagtcggtg

SEQ ID NO: 5449 - DNA, 23 bp, Artificial Sequence
  Description of Artificial Sequence: Synthetic oligonucleotide
tccgactctctagagagtcggag

SEQ ID NO: 5450 - DNA, 23 bp, Artificial Sequence
  Description of Artificial Sequence: Synthetic oligonucleotide
cgggactctctagagagtcccgc

SEQ ID NO: 5451 - DNA, 23 bp, Artificial Sequence
  Description of Artificial Sequence: Synthetic oligonucleotide
agggactctctagagagtccctc

SEQ ID NO: 5452 - DNA, 23 bp, Artificial Sequence
  Description of Artificial Sequence: Synthetic oligonucleotide
tgggactctctagagagtcccac

SEQ ID NO: 5453 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctcgcgagagtcnnnn

SEQ ID NO: 5454 - DNA, 23 bp, Artificial Sequence
  Description of Artificial Sequence: Synthetic oligonucleotide
gcggactctcgcgagagtccgcc

SEQ ID NO: 5455 - DNA, 23 bp, Artificial Sequence
  Description of Artificial Sequence: Synthetic oligonucleotide
gcggactctcgcgagagtccgct

SEQ ID NO: 5456 - DNA, 23 bp, Artificial Sequence
  Description of Artificial Sequence: Synthetic oligonucleotide
acggactctcgcgagagtccgtc

SEQ ID NO: 5457 - DNA, 23 bp, Artificial Sequence
  Description of Artificial Sequence: Synthetic oligonucleotide
gaggactctcgcgagagtcctcc

SEQ ID NO: 5458 - DNA, 23 bp, Artificial Sequence
  Description of Artificial Sequence: Synthetic oligonucleotide
gcagactctcgcgagagtctgcc

SEQ ID NO: 5459 - DNA, 23 bp, Artificial Sequence
  Description of Artificial Sequence: Synthetic oligonucleotide
gcggactctcgcgagagtccgca

SEQ ID NO: 5460 - DNA, 23 bp, Artificial Sequence
  Description of Artificial Sequence: Synthetic oligonucleotide
tcggactctcgcgagagtccgac

SEQ ID NO: 5461 - DNA, 23 bp, Artificial Sequence
  Description of Artificial Sequence: Synthetic oligonucleotide
gtggactctcgcgagagtccacc

SEQ ID NO: 5462 - DNA, 23 bp, Artificial Sequence
  Description of Artificial Sequence: Synthetic oligonucleotide
gctgactctcgcgagagtcagcc

SEQ ID NO: 5463 - DNA, 23 bp, Artificial Sequence
  Description of Artificial Sequence: Synthetic oligonucleotide
cccgactctcgcgagagtcgggc

SEQ ID NO: 5464 - DNA, 23 bp, Artificial Sequence
  Description of Artificial Sequence: Synthetic oligonucleotide
cccgactctcgcgagagtcgggt

SEQ ID NO: 5465 - DNA, 23 bp, Artificial Sequence
  Description of Artificial Sequence: Synthetic oligonucleotide
accgactctcgcgagagtcggtc

SEQ ID NO: 5466 - DNA, 23 bp, Artificial Sequence
  Description of Artificial Sequence: Synthetic oligonucleotide
cacgactctcgcgagagtcgtgc

SEQ ID NO: 5467 - DNA, 23 bp, Artificial Sequence
  Description of Artificial Sequence: Synthetic oligonucleotide
ccagactctcgcgagagtctggc

SEQ ID NO: 5468 - DNA, 23 bp, Artificial Sequence
  Description of Artificial Sequence: Synthetic oligonucleotide
cccgactctcgcgagagtcggga

SEQ ID NO: 5469 - DNA, 23 bp, Artificial Sequence
  Description of Artificial Sequence: Synthetic oligonucleotide
tccgactctcgcgagagtcggac

SEQ ID NO: 5470 - DNA, 23 bp, Artificial Sequence
  Description of Artificial Sequence: Synthetic oligonucleotide
cctgactctcgcgagagtcaggc

SEQ ID NO: 5471 - DNA, 23 bp, Artificial Sequence
  Description of Artificial Sequence: Synthetic oligonucleotide
ggcgactctcgcgagagtcgccc

SEQ ID NO: 5472 - DNA, 23 bp, Artificial Sequence
  Description of Artificial Sequence: Synthetic oligonucleotide
ggcgactctcgcgagagtcgcct

SEQ ID NO: 5473 - DNA, 23 bp, Artificial Sequence
  Description of Artificial Sequence: Synthetic oligonucleotide
agcgactctcgcgagagtcgctc

SEQ ID NO: 5474 - DNA, 23 bp, Artificial Sequence
  Description of Artificial Sequence: Synthetic oligonucleotide
gacgactctcgcgagagtcgtcc

SEQ ID NO: 5475 - DNA, 23 bp, Artificial Sequence
  Description of Artificial Sequence: Synthetic oligonucleotide
ggagactctcgcgagagtctccc

SEQ ID NO: 5476 - DNA, 23 bp, Artificial Sequence
  Description of Artificial Sequence: Synthetic oligonucleotide
ggcgactctcgcgagagtcgcca

SEQ ID NO: 5477 - DNA, 23 bp, Artificial Sequence
  Description of Artificial Sequence: Synthetic oligonucleotide
tgcgactctcgcgagagtcgcac

SEQ ID NO: 5478 - DNA, 23 bp, Artificial Sequence
  Description of Artificial Sequence: Synthetic oligonucleotide
ggtgactctcgcgagagtcaccc

SEQ ID NO: 5479 - DNA, 23 bp, Artificial Sequence
  Description of Artificial Sequence: Synthetic oligonucleotide
cgggactctcgcgagagtcccgt

SEQ ID NO: 5480 - DNA, 23 bp, Artificial Sequence
  Description of Artificial Sequence: Synthetic oligonucleotide
agggactctcgcgagagtccctg

SEQ ID NO: 5481 - DNA, 23 bp, Artificial Sequence
  Description of Artificial Sequence: Synthetic oligonucleotide
caggactctcgcgagagtcctgg

SEQ ID NO: 5482 - DNA, 23 bp, Artificial Sequence
  Description of Artificial Sequence: Synthetic oligonucleotide
cgagactctcgcgagagtctcgg

SEQ ID NO: 5483 - DNA, 23 bp, Artificial Sequence
  Description of Artificial Sequence: Synthetic oligonucleotide
cgggactctcgcgagagtcccga

SEQ ID NO: 5484 - DNA, 23 bp, Artificial Sequence
  Description of Artificial Sequence: Synthetic oligonucleotide
tgggactctcgcgagagtcccag

SEQ ID NO: 5485 - DNA, 23 bp, Artificial Sequence
  Description of Artificial Sequence: Synthetic oligonucleotide
ctggactctcgcgagagtccagg

SEQ ID NO: 5486 - DNA, 23 bp, Artificial Sequence
  Description of Artificial Sequence: Synthetic oligonucleotide
cgtgactctcgcgagagtcacgg

SEQ ID NO: 5487 - DNA, 23 bp, Artificial Sequence
  Description of Artificial Sequence: Synthetic oligonucleotide
ggcgactctcgcgagagtcgccg

SEQ ID NO: 5488 - DNA, 23 bp, Artificial Sequence
  Description of Artificial Sequence: Synthetic oligonucleotide
agcgactctcgcgagagtcgctg

SEQ ID NO: 5489 - DNA, 23 bp, Artificial Sequence
  Description of Artificial Sequence: Synthetic oligonucleotide
gacgactctcgcgagagtcgtcg

SEQ ID NO: 5490 - DNA, 23 bp, Artificial Sequence
  Description of Artificial Sequence: Synthetic oligonucleotide
ggagactctcgcgagagtctccg

SEQ ID NO: 5491 - DNA, 23 bp, Artificial Sequence
  Description of Artificial Sequence: Synthetic oligonucleotide
tgcgactctcgcgagagtcgcag

SEQ ID NO: 5492 - DNA, 23 bp, Artificial Sequence
  Description of Artificial Sequence: Synthetic oligonucleotide
ggtgactctcgcgagagtcaccg

SEQ ID NO: 5493 - DNA, 23 bp, Artificial Sequence
  Description of Artificial Sequence: Synthetic oligonucleotide
acggactctcgcgagagtccgtg

SEQ ID NO: 5494 - DNA, 23 bp, Artificial Sequence
  Description of Artificial Sequence: Synthetic oligonucleotide
ccagactctcgcgagagtctggg

SEQ ID NO: 5495 - DNA, 23 bp, Artificial Sequence
  Description of Artificial Sequence: Synthetic oligonucleotide
tcggactctcgcgagagtccgag

SEQ ID NO: 5496 - DNA, 23 bp, Artificial Sequence
  Description of Artificial Sequence: Synthetic oligonucleotide
cctgactctcgcgagagtcaggg

SEQ ID NO: 5497 - DNA, 23 bp, Artificial Sequence
  Description of Artificial Sequence: Synthetic oligonucleotide
cacgactctcgcgagagtcgtgg

SEQ ID NO: 5498 - DNA, 23 bp, Artificial Sequence
  Description of Artificial Sequence: Synthetic oligonucleotide
gccgactctcgcgagagtcggct

SEQ ID NO: 5499 - DNA, 23 bp, Artificial Sequence
  Description of Artificial Sequence: Synthetic oligonucleotide
gccgactctcgcgagagtcggca

SEQ ID NO: 5500 - DNA, 23 bp, Artificial Sequence
  Description of Artificial Sequence: Synthetic oligonucleotide
cgagactctcgcgagagtctcgc

SEQ ID NO: 5501 - DNA, 23 bp, Artificial Sequence
  Description of Artificial Sequence: Synthetic oligonucleotide
cgtgactctcgcgagagtcacgc

SEQ ID NO: 5502 - DNA, 23 bp, Artificial Sequence
  Description of Artificial Sequence: Synthetic oligonucleotide
caggactctcgcgagagtcctgc

SEQ ID NO: 5503 - DNA, 23 bp, Artificial Sequence
  Description of Artificial Sequence: Synthetic oligonucleotide
ctggactctcgcgagagtccagc

SEQ ID NO: 5504 - DNA, 23 bp, Artificial Sequence
  Description of Artificial Sequence: Synthetic oligonucleotide
gaggactctcgcgagagtcctcg

SEQ ID NO: 5505 - DNA, 23 bp, Artificial Sequence
  Description of Artificial Sequence: Synthetic oligonucleotide
gtggactctcgcgagagtccacg

SEQ ID NO: 5506 - DNA, 23 bp, Artificial Sequence
  Description of Artificial Sequence: Synthetic oligonucleotide
accgactctcgcgagagtcggtg

SEQ ID NO: 5507 - DNA, 23 bp, Artificial Sequence
  Description of Artificial Sequence: Synthetic oligonucleotide
tccgactctcgcgagagtcggag

SEQ ID NO: 5508 - DNA, 23 bp, Artificial Sequence
  Description of Artificial Sequence: Synthetic oligonucleotide
cgggactctcgcgagagtcccgc

SEQ ID NO: 5509 - DNA, 23 bp, Artificial Sequence
  Description of Artificial Sequence: Synthetic oligonucleotide
agggactctcgcgagagtccctc

SEQ ID NO: 5510 - DNA, 23 bp, Artificial Sequence
  Description of Artificial Sequence: Synthetic oligonucleotide
tgggactctcgcgagagtcccac

SEQ ID NO: 5511 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctccggagagtcnnnn

SEQ ID NO: 5512 - DNA, 23 bp, Artificial Sequence
  Description of Artificial Sequence: Synthetic oligonucleotide
gcggactctccggagagtccgcc

SEQ ID NO: 5513 - DNA, 23 bp, Artificial Sequence
  Description of Artificial Sequence: Synthetic oligonucleotide
gcggactctccggagagtccgct

SEQ ID NO: 5514 - DNA, 23 bp, Artificial Sequence
  Description of Artificial Sequence: Synthetic oligonucleotide
acggactctccggagagtccgtc

SEQ ID NO: 5515 - DNA, 23 bp, Artificial Sequence
  Description of Artificial Sequence: Synthetic oligonucleotide
gaggactctccggagagtcctcc

SEQ ID NO: 5516 - DNA, 23 bp, Artificial Sequence
  Description of Artificial Sequence: Synthetic oligonucleotide
gcagactctccggagagtctgcc

SEQ ID NO: 5517 - DNA, 23 bp, Artificial Sequence
  Description of Artificial Sequence: Synthetic oligonucleotide
gcggactctccggagagtccgca

SEQ ID NO: 5518 - DNA, 23 bp, Artificial Sequence
  Description of Artificial Sequence: Synthetic oligonucleotide
tcggactctccggagagtccgac

SEQ ID NO: 5519 - DNA, 23 bp, Artificial Sequence
  Description of Artificial Sequence: Synthetic oligonucleotide
gtggactctccggagagtccacc

SEQ ID NO: 5520 - DNA, 23 bp, Artificial Sequence
  Description of Artificial Sequence: Synthetic oligonucleotide
gctgactctccggagagtcagcc

SEQ ID NO: 5521 - DNA, 23 bp, Artificial Sequence
  Description of Artificial Sequence: Synthetic oligonucleotide
cccgactctccggagagtcgggc

SEQ ID NO: 5522 - DNA, 23 bp, Artificial Sequence
  Description of Artificial Sequence: Synthetic oligonucleotide
cccgactctccggagagtcgggt

SEQ ID NO: 5523 - DNA, 23 bp, Artificial Sequence
  Description of Artificial Sequence: Synthetic oligonucleotide
accgactctccggagagtcggtc

SEQ ID NO: 5524 - DNA, 23 bp, Artificial Sequence
  Description of Artificial Sequence: Synthetic oligonucleotide
cacgactctccggagagtcgtgc

SEQ ID NO: 5525 - DNA, 23 bp, Artificial Sequence
  Description of Artificial Sequence: Synthetic oligonucleotide
ccagactctccggagagtctggc

SEQ ID NO: 5526 - DNA, 23 bp, Artificial Sequence
  Description of Artificial Sequence: Synthetic oligonucleotide
cccgactctccggagagtcggga

SEQ ID NO: 5527 - DNA, 23 bp, Artificial Sequence
  Description of Artificial Sequence: Synthetic oligonucleotide
tccgactctccggagagtcggac

SEQ ID NO: 5528 - DNA, 23 bp, Artificial Sequence
  Description of Artificial Sequence: Synthetic oligonucleotide
cctgactctccggagagtcaggc

SEQ ID NO: 5529 - DNA, 23 bp, Artificial Sequence
  Description of Artificial Sequence: Synthetic oligonucleotide
ggcgactctccggagagtcgccc

SEQ ID NO: 5530 - DNA, 23 bp, Artificial Sequence
  Description of Artificial Sequence: Synthetic oligonucleotide
ggcgactctccggagagtcgcct

SEQ ID NO: 5531 - DNA, 23 bp, Artificial Sequence
  Description of Artificial Sequence: Synthetic oligonucleotide
agcgactctccggagagtcgctc

SEQ ID NO: 5532 - DNA, 23 bp, Artificial Sequence
  Description of Artificial Sequence: Synthetic oligonucleotide
gacgactctccggagagtcgtcc

SEQ ID NO: 5533 - DNA, 23 bp, Artificial Sequence
  Description of Artificial Sequence: Synthetic oligonucleotide
ggagactctccggagagtctccc

SEQ ID NO: 5534 - DNA, 23 bp, Artificial Sequence
  Description of Artificial Sequence: Synthetic oligonucleotide
ggcgactctccggagagtcgcca

SEQ ID NO: 5535 - DNA, 23 bp, Artificial Sequence
  Description of Artificial Sequence: Synthetic oligonucleotide
tgcgactctccggagagtcgcac

SEQ ID NO: 5536 - DNA, 23 bp, Artificial Sequence
  Description of Artificial Sequence: Synthetic oligonucleotide
ggtgactctccggagagtcaccc

SEQ ID NO: 5537 - DNA, 23 bp, Artificial Sequence
  Description of Artificial Sequence: Synthetic oligonucleotide
cgggactctccggagagtcccgt

SEQ ID NO: 5538 - DNA, 23 bp, Artificial Sequence
  Description of Artificial Sequence: Synthetic oligonucleotide
agggactctccggagagtccctg

SEQ ID NO: 5539 - DNA, 23 bp, Artificial Sequence
  Description of Artificial Sequence: Synthetic oligonucleotide
caggactctccggagagtcctgg

SEQ ID NO: 5540 - DNA, 23 bp, Artificial Sequence
  Description of Artificial Sequence: Synthetic oligonucleotide
cgagactctccggagagtctcgg

SEQ ID NO: 5541 - DNA, 23 bp, Artificial Sequence
  Description of Artificial Sequence: Synthetic oligonucleotide
cgggactctccggagagtcccga

SEQ ID NO: 5542 - DNA, 23 bp, Artificial Sequence
  Description of Artificial Sequence: Synthetic oligonucleotide
tgggactctccggagagtcccag

SEQ ID NO: 5543 - DNA, 23 bp, Artificial Sequence
  Description of Artificial Sequence: Synthetic oligonucleotide
ctggactctccggagagtccagg

SEQ ID NO: 5544 - DNA, 23 bp, Artificial Sequence
  Description of Artificial Sequence: Synthetic oligonucleotide
cgtgactctccggagagtcacgg

SEQ ID NO: 5545 - DNA, 23 bp, Artificial Sequence
  Description of Artificial Sequence: Synthetic oligonucleotide
ggcgactctccggagagtcgccg

SEQ ID NO: 5546 - DNA, 23 bp, Artificial Sequence
  Description of Artificial Sequence: Synthetic oligonucleotide
agcgactctccggagagtcgctg

SEQ ID NO: 5547 - DNA, 23 bp, Artificial Sequence
  Description of Artificial Sequence: Synthetic oligonucleotide
gacgactctccggagagtcgtcg

SEQ ID NO: 5548 - DNA, 23 bp, Artificial Sequence
  Description of Artificial Sequence: Synthetic oligonucleotide
ggagactctccggagagtctccg

SEQ ID NO: 5549 - DNA, 23 bp, Artificial Sequence
  Description of Artificial Sequence: Synthetic oligonucleotide
tgcgactctccggagagtcgcag

SEQ ID NO: 5550 - DNA, 23 bp, Artificial Sequence
  Description of Artificial Sequence: Synthetic oligonucleotide
ggtgactctccggagagtcaccg

SEQ ID NO: 5551 - DNA, 23 bp, Artificial Sequence
  Description of Artificial Sequence: Synthetic oligonucleotide
acggactctccggagagtccgtg

SEQ ID NO: 5552 - DNA, 23 bp, Artificial Sequence
  Description of Artificial Sequence: Synthetic oligonucleotide
ccagactctccggagagtctggg

SEQ ID NO: 5553 - DNA, 23 bp, Artificial Sequence
  Description of Artificial Sequence: Synthetic oligonucleotide
tcggactctccggagagtccgag

SEQ ID NO: 5554 - DNA, 23 bp, Artificial Sequence
  Description of Artificial Sequence: Synthetic oligonucleotide
cctgactctccggagagtcaggg

SEQ ID NO: 5555 - DNA, 23 bp, Artificial Sequence
  Description of Artificial Sequence: Synthetic oligonucleotide
cacgactctccggagagtcgtgg

SEQ ID NO: 5556 - DNA, 23 bp, Artificial Sequence
  Description of Artificial Sequence: Synthetic oligonucleotide
gccgactctccggagagtcggct

SEQ ID NO: 5557 - DNA, 23 bp, Artificial Sequence
  Description of Artificial Sequence: Synthetic oligonucleotide
gccgactctccggagagtcggca

SEQ ID NO: 5558 - DNA, 23 bp, Artificial Sequence
  Description of Artificial Sequence: Synthetic oligonucleotide
cgagactctccggagagtctcgc

SEQ ID NO: 5559 - DNA, 23 bp, Artificial Sequence
  Description of Artificial Sequence: Synthetic oligonucleotide
cgtgactctccggagagtcacgc

SEQ ID NO: 5560 - DNA, 23 bp, Artificial Sequence
  Description of Artificial Sequence: Synthetic oligonucleotide
caggactctccggagagtcctgc

SEQ ID NO: 5561 - DNA, 23 bp, Artificial Sequence
  Description of Artificial Sequence: Synthetic oligonucleotide
ctggactctccggagagtccagc

SEQ ID NO: 5562 - DNA, 23 bp, Artificial Sequence
  Description of Artificial Sequence: Synthetic oligonucleotide
gaggactctccggagagtcctcg

SEQ ID NO: 5563 - DNA, 23 bp, Artificial Sequence
  Description of Artificial Sequence: Synthetic oligonucleotide
gtggactctccggagagtccacg

SEQ ID NO: 5564 - DNA, 23 bp, Artificial Sequence
  Description of Artificial Sequence: Synthetic oligonucleotide
accgactctccggagagtcggtg

SEQ ID NO: 5565 - DNA, 23 bp, Artificial Sequence
  Description of Artificial Sequence: Synthetic oligonucleotide
tccgactctccggagagtcggag

SEQ ID NO: 5566 - DNA, 23 bp, Artificial Sequence
  Description of Artificial Sequence: Synthetic oligonucleotide
cgggactctccggagagtcccgc

SEQ ID NO: 5567 - DNA, 23 bp, Artificial Sequence
  Description of Artificial Sequence: Synthetic oligonucleotide
agggactctccggagagtccctc

SEQ ID NO: 5568 - DNA, 23 bp, Artificial Sequence
  Description of Artificial Sequence: Synthetic oligonucleotide
tgggactctccggagagtcccac

SEQ ID NO: 5569 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcagatctgagtcnnnn

SEQ ID NO: 5570 - DNA, 23 bp, Artificial Sequence
  Description of Artificial Sequence: Synthetic oligonucleotide
gcggactcagatctgagtccgcc

SEQ ID NO: 5571 - DNA, 23 bp, Artificial Sequence
  Description of Artificial Sequence: Synthetic oligonucleotide
gcggactcagatctgagtccgct

SEQ ID NO: 5572 - DNA, 23 bp, Artificial Sequence
  Description of Artificial Sequence: Synthetic oligonucleotide
acggactcagatctgagtccgtc

SEQ ID NO: 5573 - DNA, 23 bp, Artificial Sequence
  Description of Artificial Sequence: Synthetic oligonucleotide
gaggactcagatctgagtcctcc

SEQ ID NO: 5574 - DNA, 23 bp, Artificial Sequence
  Description of Artificial Sequence: Synthetic oligonucleotide
gcagactcagatctgagtctgcc

SEQ ID NO: 5575 - DNA, 23 bp, Artificial Sequence
  Description of Artificial Sequence: Synthetic oligonucleotide
gcggactcagatctgagtccgca

SEQ ID NO: 5576 - DNA, 23 bp, Artificial Sequence
  Description of Artificial Sequence: Synthetic oligonucleotide
tcggactcagatctgagtccgac

SEQ ID NO: 5577 - DNA, 23 bp, Artificial Sequence
  Description of Artificial Sequence: Synthetic oligonucleotide
gtggactcagatctgagtccacc

SEQ ID NO: 5578 - DNA, 23 bp, Artificial Sequence
  Description of Artificial Sequence: Synthetic oligonucleotide
gctgactcagatctgagtcagcc

SEQ ID NO: 5579 - DNA, 23 bp, Artificial Sequence
  Description of Artificial Sequence: Synthetic oligonucleotide
cccgactcagatctgagtcgggc

SEQ ID NO: 5580 - DNA, 23 bp, Artificial Sequence
  Description of Artificial Sequence: Synthetic oligonucleotide
cccgactcagatctgagtcgggt

SEQ ID NO: 5581 - DNA, 23 bp, Artificial Sequence
  Description of Artificial Sequence: Synthetic oligonucleotide
accgactcagatctgagtcggtc

SEQ ID NO: 5582 - DNA, 23 bp, Artificial Sequence
  Description of Artificial Sequence: Synthetic oligonucleotide
cacgactcagatctgagtcgtgc

SEQ ID NO: 5583 - DNA, 23 bp, Artificial Sequence
  Description of Artificial Sequence: Synthetic oligonucleotide
ccagactcagatctgagtctggc

SEQ ID NO: 5584 - DNA, 23 bp, Artificial Sequence
  Description of Artificial Sequence: Synthetic oligonucleotide
cccgactcagatctgagtcggga

SEQ ID NO: 5585 - DNA, 23 bp, Artificial Sequence
  Description of Artificial Sequence: Synthetic oligonucleotide
tccgactcagatctgagtcggac

SEQ ID NO: 5586 - DNA, 23 bp, Artificial Sequence
  Description of Artificial Sequence: Synthetic oligonucleotide
cctgactcagatctgagtcaggc

SEQ ID NO: 5587 - DNA, 23 bp, Artificial Sequence
  Description of Artificial Sequence: Synthetic oligonucleotide
ggcgactcagatctgagtcgccc

SEQ ID NO: 5588 - DNA, 23 bp, Artificial Sequence
  Description of Artificial Sequence: Synthetic oligonucleotide
ggcgactcagatctgagtcgcct

SEQ ID NO: 5589 - DNA, 23 bp, Artificial Sequence
  Description of Artificial Sequence: Synthetic oligonucleotide
agcgactcagatctgagtcgctc

SEQ ID NO: 5590 - DNA, 23 bp, Artificial Sequence
  Description of Artificial Sequence: Synthetic oligonucleotide
gacgactcagatctgagtcgtcc

SEQ ID NO: 5591 - DNA, 23 bp, Artificial Sequence
  Description of Artificial Sequence: Synthetic oligonucleotide
ggagactcagatctgagtctccc

SEQ ID NO: 5592 - DNA, 23 bp, Artificial Sequence
  Description of Artificial Sequence: Synthetic oligonucleotide
ggcgactcagatctgagtcgcca

SEQ ID NO: 5593 - DNA, 23 bp, Artificial Sequence
  Description of Artificial Sequence: Synthetic oligonucleotide
tgcgactcagatctgagtcgcac

SEQ ID NO: 5594 - DNA, 23 bp, Artificial Sequence
  Description of Artificial Sequence: Synthetic oligonucleotide
ggtgactcagatctgagtcaccc

SEQ ID NO: 5595 - DNA, 23 bp, Artificial Sequence
  Description of Artificial Sequence: Synthetic oligonucleotide
cgggactcagatctgagtcccgt

SEQ ID NO: 5596 - DNA, 23 bp, Artificial Sequence
  Description of Artificial Sequence: Synthetic oligonucleotide
agggactcagatctgagtccctg

SEQ ID NO: 5597 - DNA, 23 bp, Artificial Sequence
  Description of Artificial Sequence: Synthetic oligonucleotide
caggactcagatctgagtcctgg

SEQ ID NO: 5598 - DNA, 23 bp, Artificial Sequence
  Description of Artificial Sequence: Synthetic oligonucleotide
cgagactcagatctgagtctcgg

SEQ ID NO: 5599 - DNA, 23 bp, Artificial Sequence
  Description of Artificial Sequence: Synthetic oligonucleotide
cgggactcagatctgagtcccga

SEQ ID NO: 5600 - DNA, 23 bp, Artificial Sequence
  Description of Artificial Sequence: Synthetic oligonucleotide
tgggactcagatctgagtcccag

SEQ ID NO: 5601 - DNA, 23 bp, Artificial Sequence
  Description of Artificial Sequence: Synthetic oligonucleotide
ctggactcagatctgagtccagg

SEQ ID NO: 5602 - DNA, 23 bp, Artificial Sequence
  Description of Artificial Sequence: Synthetic oligonucleotide
cgtgactcagatctgagtcacgg

SEQ ID NO: 5603 - DNA, 23 bp, Artificial Sequence
  Description of Artificial Sequence: Synthetic oligonucleotide
ggcgactcagatctgagtcgccg

SEQ ID NO: 5604 - DNA, 23 bp, Artificial Sequence
  Description of Artificial Sequence: Synthetic oligonucleotide
agcgactcagatctgagtcgctg

SEQ ID NO: 5605 - DNA, 23 bp, Artificial Sequence
  Description of Artificial Sequence: Synthetic oligonucleotide
gacgactcagatctgagtcgtcg

SEQ ID NO: 5606 - DNA, 23 bp, Artificial Sequence
  Description of Artificial Sequence: Synthetic oligonucleotide
ggagactcagatctgagtctccg

SEQ ID NO: 5607 - DNA, 23 bp, Artificial Sequence
  Description of Artificial Sequence: Synthetic oligonucleotide
tgcgactcagatctgagtcgcag

SEQ ID NO: 5608 - DNA, 23 bp, Artificial Sequence
  Description of Artificial Sequence: Synthetic oligonucleotide
ggtgactcagatctgagtcaccg

SEQ ID NO: 5609 - DNA, 23 bp, Artificial Sequence
  Description of Artificial Sequence: Synthetic oligonucleotide
acggactcagatctgagtccgtg

SEQ ID NO: 5610 - DNA, 23 bp, Artificial Sequence
  Description of Artificial Sequence: Synthetic oligonucleotide
ccagactcagatctgagtctggg

SEQ ID NO: 5611 - DNA, 23 bp, Artificial Sequence
  Description of Artificial Sequence: Synthetic oligonucleotide
tcggactcagatctgagtccgag

SEQ ID NO: 5612 - DNA, 23 bp, Artificial Sequence
  Description of Artificial Sequence: Synthetic oligonucleotide
cctgactcagatctgagtcaggg

SEQ ID NO: 5613 - DNA, 23 bp, Artificial Sequence
  Description of Artificial Sequence: Synthetic oligonucleotide
cacgactcagatctgagtcgtgg

SEQ ID NO: 5614 - DNA, 23 bp, Artificial Sequence
  Description of Artificial Sequence: Synthetic oligonucleotide
gccgactcagatctgagtcggct

SEQ ID NO: 5615 - DNA, 23 bp, Artificial Sequence
  Description of Artificial Sequence: Synthetic oligonucleotide
gccgactcagatctgagtcggca

SEQ ID NO: 5616 - DNA, 23 bp, Artificial Sequence
  Description of Artificial Sequence: Synthetic oligonucleotide
cgagactcagatctgagtctcgc

SEQ ID NO: 5617 - DNA, 23 bp, Artificial Sequence
  Description of Artificial Sequence: Synthetic oligonucleotide
cgtgactcagatctgagtcacgc

SEQ ID NO: 5618 - DNA, 23 bp, Artificial Sequence
  Description of Artificial Sequence: Synthetic oligonucleotide
caggactcagatctgagtcctgc

SEQ ID NO: 5619 - DNA, 23 bp, Artificial Sequence
  Description of Artificial Sequence: Synthetic oligonucleotide
ctggactcagatctgagtccagc

SEQ ID NO: 5620 - DNA, 23 bp, Artificial Sequence
  Description of Artificial Sequence: Synthetic oligonucleotide
gaggactcagatctgagtcctcg

SEQ ID NO: 5621 - DNA, 23 bp, Artificial Sequence
  Description of Artificial Sequence: Synthetic oligonucleotide
gtggactcagatctgagtccacg

SEQ ID NO: 5622 - DNA, 23 bp, Artificial Sequence
  Description of Artificial Sequence: Synthetic oligonucleotide
accgactcagatctgagtcggtg

SEQ ID NO: 5623 - DNA, 23 bp, Artificial Sequence
  Description of Artificial Sequence: Synthetic oligonucleotide
tccgactcagatctgagtcggag

SEQ ID NO: 5624 - DNA, 23 bp, Artificial Sequence
  Description of Artificial Sequence: Synthetic oligonucleotide
cgggactcagatctgagtcccgc

SEQ ID NO: 5625 - DNA, 23 bp, Artificial Sequence
  Description of Artificial Sequence: Synthetic oligonucleotide
agggactcagatctgagtccctc

SEQ ID NO: 5626 - DNA, 23 bp, Artificial Sequence
  Description of Artificial Sequence: Synthetic oligonucleotide
tgggactcagatctgagtcccac

SEQ ID NO: 5627 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcagtactgagtcnnnn

SEQ ID NO: 5628 - DNA, 23 bp, Artificial Sequence
  Description of Artificial Sequence: Synthetic oligonucleotide
gcggactcagtactgagtccgcc

SEQ ID NO: 5629 - DNA, 23 bp, Artificial Sequence
  Description of Artificial Sequence: Synthetic oligonucleotide
gcggactcagtactgagtccgct

SEQ ID NO: 5630 - DNA, 23 bp, Artificial Sequence
  Description of Artificial Sequence: Synthetic oligonucleotide
acggactcagtactgagtccgtc

SEQ ID NO: 5631 - DNA, 23 bp, Artificial Sequence
  Description of Artificial Sequence: Synthetic oligonucleotide
gaggactcagtactgagtcctcc

SEQ ID NO: 5632 - DNA, 23 bp, Artificial Sequence
  Description of Artificial Sequence: Synthetic oligonucleotide
gcagactcagtactgagtctgcc

SEQ ID NO: 5633 - DNA, 23 bp, Artificial Sequence
  Description of Artificial Sequence: Synthetic oligonucleotide
gcggactcagtactgagtccgca

SEQ ID NO: 5634 - DNA, 23 bp, Artificial Sequence
  Description of Artificial Sequence: Synthetic oligonucleotide
tcggactcagtactgagtccgac

SEQ ID NO: 5635 - DNA, 23 bp, Artificial Sequence
  Description of Artificial Sequence: Synthetic oligonucleotide
gtggactcagtactgagtccacc

SEQ ID NO: 5636 - DNA, 23 bp, Artificial Sequence
  Description of Artificial Sequence: Synthetic oligonucleotide
gctgactcagtactgagtcagcc

SEQ ID NO: 5637 - DNA, 23 bp, Artificial Sequence
  Description of Artificial Sequence: Synthetic oligonucleotide
cccgactcagtactgagtcgggc

SEQ ID NO: 5638 - DNA, 23 bp, Artificial Sequence
  Description of Artificial Sequence: Synthetic oligonucleotide
cccgactcagtactgagtcgggt

SEQ ID NO: 5639 - DNA, 23 bp, Artificial Sequence
  Description of Artificial Sequence: Synthetic oligonucleotide
accgactcagtactgagtcggtc

SEQ ID NO: 5640 - DNA, 23 bp, Artificial Sequence
  Description of Artificial Sequence: Synthetic oligonucleotide
cacgactcagtactgagtcgtgc

SEQ ID NO: 5641 - DNA, 23 bp, Artificial Sequence
  Description of Artificial Sequence: Synthetic oligonucleotide
ccagactcagtactgagtctggc

SEQ ID NO: 5642 - DNA, 23 bp, Artificial Sequence
  Description of Artificial Sequence: Synthetic oligonucleotide
cccgactcagtactgagtcggga

SEQ ID NO: 5643 - DNA, 23 bp, Artificial Sequence
  Description of Artificial Sequence: Synthetic oligonucleotide
tccgactcagtactgagtcggac

SEQ ID NO: 5644 - DNA, 23 bp, Artificial Sequence
  Description of Artificial Sequence: Synthetic oligonucleotide
cctgactcagtactgagtcaggc

SEQ ID NO: 5645 - DNA, 23 bp, Artificial Sequence
  Description of Artificial Sequence: Synthetic oligonucleotide
ggcgactcagtactgagtcgccc

SEQ ID NO: 5646 - DNA, 23 bp, Artificial Sequence
  Description of Artificial Sequence: Synthetic oligonucleotide
ggcgactcagtactgagtcgcct

SEQ ID NO: 5647 - DNA, 23 bp, Artificial Sequence
  Description of Artificial Sequence: Synthetic oligonucleotide
agcgactcagtactgagtcgctc

SEQ ID NO: 5648 - DNA, 23 bp, Artificial Sequence
  Description of Artificial Sequence: Synthetic oligonucleotide
gacgactcagtactgagtcgtcc

SEQ ID NO: 5649 - DNA, 23 bp, Artificial Sequence
  Description of Artificial Sequence: Synthetic oligonucleotide
ggagactcagtactgagtctccc

SEQ ID NO: 5650 - DNA, 23 bp, Artificial Sequence
  Description of Artificial Sequence: Synthetic oligonucleotide
ggcgactcagtactgagtcgcca

SEQ ID NO: 5651 - DNA, 23 bp, Artificial Sequence
  Description of Artificial Sequence: Synthetic oligonucleotide
tgcgactcagtactgagtcgcac

SEQ ID NO: 5652 - DNA, 23 bp, Artificial Sequence
  Description of Artificial Sequence: Synthetic oligonucleotide
ggtgactcagtactgagtcaccc

SEQ ID NO: 5653 - DNA, 23 bp, Artificial Sequence
  Description of Artificial Sequence: Synthetic oligonucleotide
cgggactcagtactgagtcccgt

SEQ ID NO: 5654 - DNA, 23 bp, Artificial Sequence
  Description of Artificial Sequence: Synthetic oligonucleotide
agggactcagtactgagtccctg

SEQ ID NO: 5655 - DNA, 23 bp, Artificial Sequence
  Description of Artificial Sequence: Synthetic oligonucleotide
caggactcagtactgagtcctgg

SEQ ID NO: 5656 - DNA, 23 bp, Artificial Sequence
  Description of Artificial Sequence: Synthetic oligonucleotide
cgagactcagtactgagtctcgg

SEQ ID NO: 5657 - DNA, 23 bp, Artificial Sequence
  Description of Artificial Sequence: Synthetic oligonucleotide
cgggactcagtactgagtcccga

SEQ ID NO: 5658 - DNA, 23 bp, Artificial Sequence
  Description of Artificial Sequence: Synthetic oligonucleotide
tgggactcagtactgagtcccag

SEQ ID NO: 5659 - DNA, 23 bp, Artificial Sequence
  Description of Artificial Sequence: Synthetic oligonucleotide
ctggactcagtactgagtccagg

SEQ ID NO: 5660 - DNA, 23 bp, Artificial Sequence
  Description of Artificial Sequence: Synthetic oligonucleotide
cgtgactcagtactgagtcacgg

SEQ ID NO: 5661 - DNA, 23 bp, Artificial Sequence
  Description of Artificial Sequence: Synthetic oligonucleotide
ggcgactcagtactgagtcgccg

SEQ ID NO: 5662 - DNA, 23 bp, Artificial Sequence
  Description of Artificial Sequence: Synthetic oligonucleotide
agcgactcagtactgagtcgctg

SEQ ID NO: 5663 - DNA, 23 bp, Artificial Sequence
  Description of Artificial Sequence: Synthetic oligonucleotide
gacgactcagtactgagtcgtcg

SEQ ID NO: 5664 - DNA, 23 bp, Artificial Sequence
  Description of Artificial Sequence: Synthetic oligonucleotide
ggagactcagtactgagtctccg

SEQ ID NO: 5665 - DNA, 23 bp, Artificial Sequence
  Description of Artificial Sequence: Synthetic oligonucleotide
tgcgactcagtactgagtcgcag

SEQ ID NO: 5666 - DNA, 23 bp, Artificial Sequence
  Description of Artificial Sequence: Synthetic oligonucleotide
ggtgactcagtactgagtcaccg

SEQ ID NO: 5667 - DNA, 23 bp, Artificial Sequence
  Description of Artificial Sequence: Synthetic oligonucleotide
acggactcagtactgagtccgtg

SEQ ID NO: 5668 - DNA, 23 bp, Artificial Sequence
  Description of Artificial Sequence: Synthetic oligonucleotide
ccagactcagtactgagtctggg

SEQ ID NO: 5669 - DNA, 23 bp, Artificial Sequence
  Description of Artificial Sequence: Synthetic oligonucleotide
tcggactcagtactgagtccgag

SEQ ID NO: 5670 - DNA, 23 bp, Artificial Sequence
  Description of Artificial Sequence: Synthetic oligonucleotide
cctgactcagtactgagtcaggg

SEQ ID NO: 5671 - DNA, 23 bp, Artificial Sequence
  Description of Artificial Sequence: Synthetic oligonucleotide
cacgactcagtactgagtcgtgg

SEQ ID NO: 5672 - DNA, 23 bp, Artificial Sequence
  Description of Artificial Sequence: Synthetic oligonucleotide
gccgactcagtactgagtcggct

SEQ ID NO: 5673 - DNA, 23 bp, Artificial Sequence
  Description of Artificial Sequence: Synthetic oligonucleotide
gccgactcagtactgagtcggca

SEQ ID NO: 5674 - DNA, 23 bp, Artificial Sequence
  Description of Artificial Sequence: Synthetic oligonucleotide
cgagactcagtactgagtctcgc

SEQ ID NO: 5675 - DNA, 23 bp, Artificial Sequence
  Description of Artificial Sequence: Synthetic oligonucleotide
cgtgactcagtactgagtcacgc

SEQ ID NO: 5676 - DNA, 23 bp, Artificial Sequence
  Description of Artificial Sequence: Synthetic oligonucleotide
caggactcagtactgagtcctgc

SEQ ID NO: 5677 - DNA, 23 bp, Artificial Sequence
  Description of Artificial Sequence: Synthetic oligonucleotide
ctggactcagtactgagtccagc

SEQ ID NO: 5678 - DNA, 23 bp, Artificial Sequence
  Description of Artificial Sequence: Synthetic oligonucleotide
gaggactcagtactgagtcctcg

SEQ ID NO: 5679 - DNA, 23 bp, Artificial Sequence
  Description of Artificial Sequence: Synthetic oligonucleotide
gtggactcagtactgagtccacg

SEQ ID NO: 5680 - DNA, 23 bp, Artificial Sequence
  Description of Artificial Sequence: Synthetic oligonucleotide
accgactcagtactgagtcggtg

SEQ ID NO: 5681 - DNA, 23 bp, Artificial Sequence
  Description of Artificial Sequence: Synthetic oligonucleotide
tccgactcagtactgagtcggag

SEQ ID NO: 5682 - DNA, 23 bp, Artificial Sequence
  Description of Artificial Sequence: Synthetic oligonucleotide
cgggactcagtactgagtcccgc

SEQ ID NO: 5683 - DNA, 23 bp, Artificial Sequence
  Description of Artificial Sequence: Synthetic oligonucleotide
agggactcagtactgagtccctc

SEQ ID NO: 5684 - DNA, 23 bp, Artificial Sequence
  Description of Artificial Sequence: Synthetic oligonucleotide
tgggactcagtactgagtcccac

SEQ ID NO: 5685 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaggcctgagtcnnnn

SEQ ID NO: 5686 - DNA, 23 bp, Artificial Sequence
  Description of Artificial Sequence: Synthetic oligonucleotide
gcggactcaggcctgagtccgcc

SEQ ID NO: 5687 - DNA, 23 bp, Artificial Sequence
  Description of Artificial Sequence: Synthetic oligonucleotide
gcggactcaggcctgagtccgct

SEQ ID NO: 5688 - DNA, 23 bp, Artificial Sequence
  Description of Artificial Sequence: Synthetic oligonucleotide
acggactcaggcctgagtccgtc

SEQ ID NO: 5689 - DNA, 23 bp, Artificial Sequence
  Description of Artificial Sequence: Synthetic oligonucleotide
gaggactcaggcctgagtcctcc

SEQ ID NO: 5690 - DNA, 23 bp, Artificial Sequence
  Description of Artificial Sequence: Synthetic oligonucleotide
gcagactcaggcctgagtctgcc

SEQ ID NO: 5691 - DNA, 23 bp, Artificial Sequence
  Description of Artificial Sequence: Synthetic oligonucleotide
gcggactcaggcctgagtccgca

SEQ ID NO: 5692 - DNA, 23 bp, Artificial Sequence
  Description of Artificial Sequence: Synthetic oligonucleotide
tcggactcaggcctgagtccgac

SEQ ID NO: 5693 - DNA, 23 bp, Artificial Sequence
  Description of Artificial Sequence: Synthetic oligonucleotide
gtggactcaggcctgagtccacc

SEQ ID NO: 5694 - DNA, 23 bp, Artificial Sequence
  Description of Artificial Sequence: Synthetic oligonucleotide
gctgactcaggcctgagtcagcc

SEQ ID NO: 5695 - DNA, 23 bp, Artificial Sequence
  Description of Artificial Sequence: Synthetic oligonucleotide
cccgactcaggcctgagtcgggc

SEQ ID NO: 5696 - DNA, 23 bp, Artificial Sequence
  Description of Artificial Sequence: Synthetic oligonucleotide
cccgactcaggcctgagtcgggt

SEQ ID NO: 5697 - DNA, 23 bp, Artificial Sequence
  Description of Artificial Sequence: Synthetic oligonucleotide
accgactcaggcctgagtcggtc

SEQ ID NO: 5698 - DNA, 23 bp, Artificial Sequence
  Description of Artificial Sequence: Synthetic oligonucleotide
cacgactcaggcctgagtcgtgc

SEQ ID NO: 5699 - DNA, 23 bp, Artificial Sequence
  Description of Artificial Sequence: Synthetic oligonucleotide
ccagactcaggcctgagtctggc

SEQ ID NO: 5700 - DNA, 23 bp, Artificial Sequence
  Description of Artificial Sequence: Synthetic oligonucleotide
cccgactcaggcctgagtcggga

SEQ ID NO: 5701 - DNA, 23 bp, Artificial Sequence
  Description of Artificial Sequence: Synthetic oligonucleotide
tccgactcaggcctgagtcggac

SEQ ID NO: 5702 - DNA, 23 bp, Artificial Sequence
  Description of Artificial Sequence: Synthetic oligonucleotide
cctgactcaggcctgagtcaggc

SEQ ID NO: 5703 - DNA, 23 bp, Artificial Sequence
  Description of Artificial Sequence: Synthetic oligonucleotide
ggcgactcaggcctgagtcgccc

SEQ ID NO: 5704 - DNA, 23 bp, Artificial Sequence
  Description of Artificial Sequence: Synthetic oligonucleotide
ggcgactcaggcctgagtcgcct

SEQ ID NO: 5705 - DNA, 23 bp, Artificial Sequence
  Description of Artificial Sequence: Synthetic oligonucleotide
agcgactcaggcctgagtcgctc

SEQ ID NO: 5706 - DNA, 23 bp, Artificial Sequence
  Description of Artificial Sequence: Synthetic oligonucleotide
gacgactcaggcctgagtcgtcc

SEQ ID NO: 5707 - DNA, 23 bp, Artificial Sequence
  Description of Artificial Sequence: Synthetic oligonucleotide
ggagactcaggcctgagtctccc

SEQ ID NO: 5708 - DNA, 23 bp, Artificial Sequence
  Description of Artificial Sequence: Synthetic oligonucleotide
ggcgactcaggcctgagtcgcca

SEQ ID NO: 5709 - DNA, 23 bp, Artificial Sequence
  Description of Artificial Sequence: Synthetic oligonucleotide
tgcgactcaggcctgagtcgcac

SEQ ID NO: 5710 - DNA, 23 bp, Artificial Sequence
  Description of Artificial Sequence: Synthetic oligonucleotide
ggtgactcaggcctgagtcaccc

SEQ ID NO: 5711 - DNA, 23 bp, Artificial Sequence
  Description of Artificial Sequence: Synthetic oligonucleotide
cgggactcaggcctgagtcccgt

SEQ ID NO: 5712 - DNA, 23 bp, Artificial Sequence
  Description of Artificial Sequence: Synthetic oligonucleotide
agggactcaggcctgagtccctg

SEQ ID NO: 5713 - DNA, 23 bp, Artificial Sequence
  Description of Artificial Sequence: Synthetic oligonucleotide
caggactcaggcctgagtcctgg

SEQ ID NO: 5714 - DNA, 23 bp, Artificial Sequence
  Description of Artificial Sequence: Synthetic oligonucleotide
cgagactcaggcctgagtctcgg

SEQ ID NO: 5715 - DNA, 23 bp, Artificial Sequence
  Description of Artificial Sequence: Synthetic oligonucleotide
cgggactcaggcctgagtcccga

SEQ ID NO: 5716 - DNA, 23 bp, Artificial Sequence
  Description of Artificial Sequence: Synthetic oligonucleotide
tgggactcaggcctgagtcccag

SEQ ID NO: 5717 - DNA, 23 bp, Artificial Sequence
  Description of Artificial Sequence: Synthetic oligonucleotide
ctggactcaggcctgagtccagg

SEQ ID NO: 5718 - DNA, 23 bp, Artificial Sequence
  Description of Artificial Sequence: Synthetic oligonucleotide
cgtgactcaggcctgagtcacgg

SEQ ID NO: 5719 - DNA, 23 bp, Artificial Sequence
  Description of Artificial Sequence: Synthetic oligonucleotide
ggcgactcaggcctgagtcgccg

SEQ ID NO: 5720 - DNA, 23 bp, Artificial Sequence
  Description of Artificial Sequence: Synthetic oligonucleotide
agcgactcaggcctgagtcgctg

SEQ ID NO: 5721 - DNA, 23 bp, Artificial Sequence
  Description of Artificial Sequence: Synthetic oligonucleotide
gacgactcaggcctgagtcgtcg

SEQ ID NO: 5722 - DNA, 23 bp, Artificial Sequence
  Description of Artificial Sequence: Synthetic oligonucleotide
ggagactcaggcctgagtctccg

SEQ ID NO: 5723 - DNA, 23 bp, Artificial Sequence
  Description of Artificial Sequence: Synthetic oligonucleotide
tgcgactcaggcctgagtcgcag

SEQ ID NO: 5724 - DNA, 23 bp, Artificial Sequence
  Description of Artificial Sequence: Synthetic oligonucleotide
ggtgactcaggcctgagtcaccg

SEQ ID NO: 5725 - DNA, 23 bp, Artificial Sequence
  Description of Artificial Sequence: Synthetic oligonucleotide
acggactcaggcctgagtccgtg

SEQ ID NO: 5726 - DNA, 23 bp, Artificial Sequence
  Description of Artificial Sequence: Synthetic oligonucleotide
ccagactcaggcctgagtctggg

SEQ ID NO: 5727 - DNA, 23 bp, Artificial Sequence
  Description of Artificial Sequence: Synthetic oligonucleotide
tcggactcaggcctgagtccgag

SEQ ID NO: 5728 - DNA, 23 bp, Artificial Sequence
  Description of Artificial Sequence: Synthetic oligonucleotide
cctgactcaggcctgagtcaggg

SEQ ID NO: 5729 - DNA, 23 bp, Artificial Sequence
  Description of Artificial Sequence: Synthetic oligonucleotide
cacgactcaggcctgagtcgtgg

SEQ ID NO: 5730 - DNA, 23 bp, Artificial Sequence
  Description of Artificial Sequence: Synthetic oligonucleotide
gccgactcaggcctgagtcggct

SEQ ID NO: 5731 - DNA, 23 bp, Artificial Sequence
  Description of Artificial Sequence: Synthetic oligonucleotide
gccgactcaggcctgagtcggca

SEQ ID NO: 5732 - DNA, 23 bp, Artificial Sequence
  Description of Artificial Sequence: Synthetic oligonucleotide
cgagactcaggcctgagtctcgc

SEQ ID NO: 5733 - DNA, 23 bp, Artificial Sequence
  Description of Artificial Sequence: Synthetic oligonucleotide
cgtgactcaggcctgagtcacgc

SEQ ID NO: 5734 - DNA, 23 bp, Artificial Sequence
  Description of Artificial Sequence: Synthetic oligonucleotide
caggactcaggcctgagtcctgc

SEQ ID NO: 5735 - DNA, 23 bp, Artificial Sequence
  Description of Artificial Sequence: Synthetic oligonucleotide
ctggactcaggcctgagtccagc

SEQ ID NO: 5736 - DNA, 23 bp, Artificial Sequence
  Description of Artificial Sequence: Synthetic oligonucleotide
gaggactcaggcctgagtcctcg

SEQ ID NO: 5737 - DNA, 23 bp, Artificial Sequence
  Description of Artificial Sequence: Synthetic oligonucleotide
gtggactcaggcctgagtccacg

SEQ ID NO: 5738 - DNA, 23 bp, Artificial Sequence
  Description of Artificial Sequence: Synthetic oligonucleotide
accgactcaggcctgagtcggtg

SEQ ID NO: 5739 - DNA, 23 bp, Artificial Sequence
  Description of Artificial Sequence: Synthetic oligonucleotide
tccgactcaggcctgagtcggag

SEQ ID NO: 5740 - DNA, 23 bp, Artificial Sequence
  Description of Artificial Sequence: Synthetic oligonucleotide
cgggactcaggcctgagtcccgc

SEQ ID NO: 5741 - DNA, 23 bp, Artificial Sequence
  Description of Artificial Sequence: Synthetic oligonucleotide
agggactcaggcctgagtccctc

SEQ ID NO: 5742 - DNA, 23 bp, Artificial Sequence
  Description of Artificial Sequence: Synthetic oligonucleotide
tgggactcaggcctgagtcccac

SEQ ID NO: 5743 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcagcgctgagtcnnnn

SEQ ID NO: 5744 - DNA, 23 bp, Artificial Sequence
  Description of Artificial Sequence: Synthetic oligonucleotide
gcggactcagcgctgagtccgcc

SEQ ID NO: 5745 - DNA, 23 bp, Artificial Sequence
  Description of Artificial Sequence: Synthetic oligonucleotide
gcggactcagcgctgagtccgct

SEQ ID NO: 5746 - DNA, 23 bp, Artificial Sequence
  Description of Artificial Sequence: Synthetic oligonucleotide
acggactcagcgctgagtccgtc

SEQ ID NO: 5747 - DNA, 23 bp, Artificial Sequence
  Description of Artificial Sequence: Synthetic oligonucleotide
gaggactcagcgctgagtcctcc

SEQ ID NO: 5748 - DNA, 23 bp, Artificial Sequence
  Description of Artificial Sequence: Synthetic oligonucleotide
gcagactcagcgctgagtctgcc

SEQ ID NO: 5749 - DNA, 23 bp, Artificial Sequence
  Description of Artificial Sequence: Synthetic oligonucleotide
gcggactcagcgctgagtccgca

SEQ ID NO: 5750 - DNA, 23 bp, Artificial Sequence
  Description of Artificial Sequence: Synthetic oligonucleotide
tcggactcagcgctgagtccgac

SEQ ID NO: 5751 - DNA, 23 bp, Artificial Sequence
  Description of Artificial Sequence: Synthetic oligonucleotide
gtggactcagcgctgagtccacc

SEQ ID NO: 5752 - DNA, 23 bp, Artificial Sequence
  Description of Artificial Sequence: Synthetic oligonucleotide
gctgactcagcgctgagtcagcc

SEQ ID NO: 5753 - DNA, 23 bp, Artificial Sequence
  Description of Artificial Sequence: Synthetic oligonucleotide
cccgactcagcgctgagtcgggc

SEQ ID NO: 5754 - DNA, 23 bp, Artificial Sequence
  Description of Artificial Sequence: Synthetic oligonucleotide
cccgactcagcgctgagtcgggt

SEQ ID NO: 5755 - DNA, 23 bp, Artificial Sequence
  Description of Artificial Sequence: Synthetic oligonucleotide
accgactcagcgctgagtcggtc

SEQ ID NO: 5756 - DNA, 23 bp, Artificial Sequence
  Description of Artificial Sequence: Synthetic oligonucleotide
cacgactcagcgctgagtcgtgc

SEQ ID NO: 5757 - DNA, 23 bp, Artificial Sequence
  Description of Artificial Sequence: Synthetic oligonucleotide
ccagactcagcgctgagtctggc

SEQ ID NO: 5758 - DNA, 23 bp, Artificial Sequence
  Description of Artificial Sequence: Synthetic oligonucleotide
cccgactcagcgctgagtcggga

SEQ ID NO: 5759 - DNA, 23 bp, Artificial Sequence
  Description of Artificial Sequence: Synthetic oligonucleotide
tccgactcagcgctgagtcggac

SEQ ID NO: 5760 - DNA, 23 bp, Artificial Sequence
  Description of Artificial Sequence: Synthetic oligonucleotide
cctgactcagcgctgagtcaggc

SEQ ID NO: 5761 - DNA, 23 bp, Artificial Sequence
  Description of Artificial Sequence: Synthetic oligonucleotide
ggcgactcagcgctgagtcgccc

SEQ ID NO: 5762 - DNA, 23 bp, Artificial Sequence
  Description of Artificial Sequence: Synthetic oligonucleotide
ggcgactcagcgctgagtcgcct

SEQ ID NO: 5763 - DNA, 23 bp, Artificial Sequence
  Description of Artificial Sequence: Synthetic oligonucleotide
agcgactcagcgctgagtcgctc

SEQ ID NO: 5764 - DNA, 23 bp, Artificial Sequence
  Description of Artificial Sequence: Synthetic oligonucleotide
gacgactcagcgctgagtcgtcc

SEQ ID NO: 5765 - DNA, 23 bp, Artificial Sequence
  Description of Artificial Sequence: Synthetic oligonucleotide
ggagactcagcgctgagtctccc

SEQ ID NO: 5766 - DNA, 23 bp, Artificial Sequence
  Description of Artificial Sequence: Synthetic oligonucleotide
ggcgactcagcgctgagtcgcca

SEQ ID NO: 5767 - DNA, 23 bp, Artificial Sequence
  Description of Artificial Sequence: Synthetic oligonucleotide
tgcgactcagcgctgagtcgcac

SEQ ID NO: 5768 - DNA, 23 bp, Artificial Sequence
  Description of Artificial Sequence: Synthetic oligonucleotide
ggtgactcagcgctgagtcaccc

SEQ ID NO: 5769 - DNA, 23 bp, Artificial Sequence
  Description of Artificial Sequence: Synthetic oligonucleotide
cgggactcagcgctgagtcccgt

SEQ ID NO: 5770 - DNA, 23 bp, Artificial Sequence
  Description of Artificial Sequence: Synthetic oligonucleotide
agggactcagcgctgagtccctg

SEQ ID NO: 5771 - DNA, 23 bp, Artificial Sequence
  Description of Artificial Sequence: Synthetic oligonucleotide
caggactcagcgctgagtcctgg

SEQ ID NO: 5772 - DNA, 23 bp, Artificial Sequence
  Description of Artificial Sequence: Synthetic oligonucleotide
cgagactcagcgctgagtctcgg

SEQ ID NO: 5773 - DNA, 23 bp, Artificial Sequence
  Description of Artificial Sequence: Synthetic oligonucleotide
cgggactcagcgctgagtcccga

SEQ ID NO: 5774 - DNA, 23 bp, Artificial Sequence
  Description of Artificial Sequence: Synthetic oligonucleotide
tgggactcagcgctgagtcccag

SEQ ID NO: 5775 - DNA, 23 bp, Artificial Sequence
  Description of Artificial Sequence: Synthetic oligonucleotide
ctggactcagcgctgagtccagg

SEQ ID NO: 5776 - DNA, 23 bp, Artificial Sequence
  Description of Artificial Sequence: Synthetic oligonucleotide
cgtgactcagcgctgagtcacgg

SEQ ID NO: 5777 - DNA, 23 bp, Artificial Sequence
  Description of Artificial Sequence: Synthetic oligonucleotide
ggcgactcagcgctgagtcgccg

SEQ ID NO: 5778 - DNA, 23 bp, Artificial Sequence
  Description of Artificial Sequence: Synthetic oligonucleotide
agcgactcagcgctgagtcgctg

SEQ ID NO: 5779 - DNA, 23 bp, Artificial Sequence
  Description of Artificial Sequence: Synthetic oligonucleotide
gacgactcagcgctgagtcgtcg

SEQ ID NO: 5780 - DNA, 23 bp, Artificial Sequence
  Description of Artificial Sequence: Synthetic oligonucleotide
ggagactcagcgctgagtctccg

SEQ ID NO: 5781 - DNA, 23 bp, Artificial Sequence
  Description of Artificial Sequence: Synthetic oligonucleotide
tgcgactcagcgctgagtcgcag

SEQ ID NO: 5782 - DNA, 23 bp, Artificial Sequence
  Description of Artificial Sequence: Synthetic oligonucleotide
ggtgactcagcgctgagtcaccg

SEQ ID NO: 5783 - DNA, 23 bp, Artificial Sequence
  Description of Artificial Sequence: Synthetic oligonucleotide
acggactcagcgctgagtccgtg

SEQ ID NO: 5784 - DNA, 23 bp, Artificial Sequence
  Description of Artificial Sequence: Synthetic oligonucleotide
ccagactcagcgctgagtctggg

SEQ ID NO: 5785 - DNA, 23 bp, Artificial Sequence
  Description of Artificial Sequence: Synthetic oligonucleotide
tcggactcagcgctgagtccgag

SEQ ID NO: 5786 - DNA, 23 bp, Artificial Sequence
  Description of Artificial Sequence: Synthetic oligonucleotide
cctgactcagcgctgagtcaggg

SEQ ID NO: 5787 - DNA, 23 bp, Artificial Sequence
  Description of Artificial Sequence: Synthetic oligonucleotide
cacgactcagcgctgagtcgtgg

SEQ ID NO: 5788 - DNA, 23 bp, Artificial Sequence
  Description of Artificial Sequence: Synthetic oligonucleotide
gccgactcagcgctgagtcggct

SEQ ID NO: 5789 - DNA, 23 bp, Artificial Sequence
  Description of Artificial Sequence: Synthetic oligonucleotide
gccgactcagcgctgagtcggca

SEQ ID NO: 5790 - DNA, 23 bp, Artificial Sequence
  Description of Artificial Sequence: Synthetic oligonucleotide
cgagactcagcgctgagtctcgc

SEQ ID NO: 5791 - DNA, 23 bp, Artificial Sequence
  Description of Artificial Sequence: Synthetic oligonucleotide
cgtgactcagcgctgagtcacgc

SEQ ID NO: 5792 - DNA, 23 bp, Artificial Sequence
  Description of Artificial Sequence: Synthetic oligonucleotide
caggactcagcgctgagtcctgc

SEQ ID NO: 5793 - DNA, 23 bp, Artificial Sequence
  Description of Artificial Sequence: Synthetic oligonucleotide
ctggactcagcgctgagtccagc

SEQ ID NO: 5794 - DNA, 23 bp, Artificial Sequence
  Description of Artificial Sequence: Synthetic oligonucleotide
gaggactcagcgctgagtcctcg

SEQ ID NO: 5795 - DNA, 23 bp, Artificial Sequence
  Description of Artificial Sequence: Synthetic oligonucleotide
gtggactcagcgctgagtccacg

SEQ ID NO: 5796 - DNA, 23 bp, Artificial Sequence
  Description of Artificial Sequence: Synthetic oligonucleotide
accgactcagcgctgagtcggtg

SEQ ID NO: 5797 - DNA, 23 bp, Artificial Sequence
  Description of Artificial Sequence: Synthetic oligonucleotide
tccgactcagcgctgagtcggag

SEQ ID NO: 5798 - DNA, 23 bp, Artificial Sequence
  Description of Artificial Sequence: Synthetic oligonucleotide
cgggactcagcgctgagtcccgc

SEQ ID NO: 5799 - DNA, 23 bp, Artificial Sequence
  Description of Artificial Sequence: Synthetic oligonucleotide
agggactcagcgctgagtccctc

SEQ ID NO: 5800 - DNA, 23 bp, Artificial Sequence
  Description of Artificial Sequence: Synthetic oligonucleotide
tgggactcagcgctgagtcccac

SEQ ID NO: 5801 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaaatttgagtcnnnn

SEQ ID NO: 5802 - DNA, 23 bp, Artificial Sequence
  Description of Artificial Sequence: Synthetic oligonucleotide
gcggactcaaatttgagtccgcc

SEQ ID NO: 5803 - DNA, 23 bp, Artificial Sequence
  Description of Artificial Sequence: Synthetic oligonucleotide
gcggactcaaatttgagtccgct

SEQ ID NO: 5804 - DNA, 23 bp, Artificial Sequence
  Description of Artificial Sequence: Synthetic oligonucleotide
acggactcaaatttgagtccgtc

SEQ ID NO: 5805 - DNA, 23 bp, Artificial Sequence
  Description of Artificial Sequence: Synthetic oligonucleotide
gaggactcaaatttgagtcctcc

SEQ ID NO: 5806 - DNA, 23 bp, Artificial Sequence
  Description of Artificial Sequence: Synthetic oligonucleotide
gcagactcaaatttgagtctgcc

SEQ ID NO: 5807 - DNA, 23 bp, Artificial Sequence
  Description of Artificial Sequence: Synthetic oligonucleotide
gcggactcaaatttgagtccgca

SEQ ID NO: 5808 - DNA, 23 bp, Artificial Sequence
  Description of Artificial Sequence: Synthetic oligonucleotide
tcggactcaaatttgagtccgac

SEQ ID NO: 5809 - DNA, 23 bp, Artificial Sequence
  Description of Artificial Sequence: Synthetic oligonucleotide
gtggactcaaatttgagtccacc

SEQ ID NO: 5810 - DNA, 23 bp, Artificial Sequence
  Description of Artificial Sequence: Synthetic oligonucleotide
gctgactcaaatttgagtcagcc

SEQ ID NO: 5811 - DNA, 23 bp, Artificial Sequence
  Description of Artificial Sequence: Synthetic oligonucleotide
cccgactcaaatttgagtcgggc

SEQ ID NO: 5812 - DNA, 23 bp, Artificial Sequence
  Description of Artificial Sequence: Synthetic oligonucleotide
cccgactcaaatttgagtcgggt

SEQ ID NO: 5813 - DNA, 23 bp, Artificial Sequence
  Description of Artificial Sequence: Synthetic oligonucleotide
accgactcaaatttgagtcggtc

SEQ ID NO: 5814 - DNA, 23 bp, Artificial Sequence
  Description of Artificial Sequence: Synthetic oligonucleotide
cacgactcaaatttgagtcgtgc

SEQ ID NO: 5815 - DNA, 23 bp, Artificial Sequence
  Description of Artificial Sequence: Synthetic oligonucleotide
ccagactcaaatttgagtctggc

SEQ ID NO: 5816 - DNA, 23 bp, Artificial Sequence
  Description of Artificial Sequence: Synthetic oligonucleotide
cccgactcaaatttgagtcggga

SEQ ID NO: 5817 - DNA, 23 bp, Artificial Sequence
  Description of Artificial Sequence: Synthetic oligonucleotide
tccgactcaaatttgagtcggac

SEQ ID NO: 5818 - DNA, 23 bp, Artificial Sequence
  Description of Artificial Sequence: Synthetic oligonucleotide
cctgactcaaatttgagtcaggc

SEQ ID NO: 5819 - DNA, 23 bp, Artificial Sequence
  Description of Artificial Sequence: Synthetic oligonucleotide
ggcgactcaaatttgagtcgccc

SEQ ID NO: 5820 - DNA, 23 bp, Artificial Sequence
  Description of Artificial Sequence: Synthetic oligonucleotide
ggcgactcaaatttgagtcgcct

SEQ ID NO: 5821 - DNA, 23 bp, Artificial Sequence
  Description of Artificial Sequence: Synthetic oligonucleotide
agcgactcaaatttgagtcgctc

SEQ ID NO: 5822 - DNA, 23 bp, Artificial Sequence
  Description of Artificial Sequence: Synthetic oligonucleotide
gacgactcaaatttgagtcgtcc

SEQ ID NO: 5823 - DNA, 23 bp, Artificial Sequence
  Description of Artificial Sequence: Synthetic oligonucleotide
ggagactcaaatttgagtctccc

SEQ ID NO: 5824 - DNA, 23 bp, Artificial Sequence
  Description of Artificial Sequence: Synthetic oligonucleotide
ggcgactcaaatttgagtcgcca

SEQ ID NO: 5825 - DNA, 23 bp, Artificial Sequence
  Description of Artificial Sequence: Synthetic oligonucleotide
tgcgactcaaatttgagtcgcac

SEQ ID NO: 5826 - DNA, 23 bp, Artificial Sequence
  Description of Artificial Sequence: Synthetic oligonucleotide
ggtgactcaaatttgagtcaccc

SEQ ID NO: 5827 - DNA, 23 bp, Artificial Sequence
  Description of Artificial Sequence: Synthetic oligonucleotide
cgggactcaaatttgagtcccgt

SEQ ID NO: 5828 - DNA, 23 bp, Artificial Sequence
  Description of Artificial Sequence: Synthetic oligonucleotide
agggactcaaatttgagtccctg

SEQ ID NO: 5829 - DNA, 23 bp, Artificial Sequence
  Description of Artificial Sequence: Synthetic oligonucleotide
caggactcaaatttgagtcctgg

SEQ ID NO: 5830 - DNA, 23 bp, Artificial Sequence
  Description of Artificial Sequence: Synthetic oligonucleotide
cgagactcaaatttgagtctcgg

SEQ ID NO: 5831 - DNA, 23 bp, Artificial Sequence
  Description of Artificial Sequence: Synthetic oligonucleotide
cgggactcaaatttgagtcccga

SEQ ID NO: 5832 - DNA, 23 bp, Artificial Sequence
  Description of Artificial Sequence: Synthetic oligonucleotide
tgggactcaaatttgagtcccag

SEQ ID NO: 5833 - DNA, 23 bp, Artificial Sequence
  Description of Artificial Sequence: Synthetic oligonucleotide
ctggactcaaatttgagtccagg

SEQ ID NO: 5834 - DNA, 23 bp, Artificial Sequence
  Description of Artificial Sequence: Synthetic oligonucleotide
cgtgactcaaatttgagtcacgg

SEQ ID NO: 5835 - DNA, 23 bp, Artificial Sequence
  Description of Artificial Sequence: Synthetic oligonucleotide
ggcgactcaaatttgagtcgccg

SEQ ID NO: 5836 - DNA, 23 bp, Artificial Sequence
  Description of Artificial Sequence: Synthetic oligonucleotide
agcgactcaaatttgagtcgctg

SEQ ID NO: 5837 - DNA, 23 bp, Artificial Sequence
  Description of Artificial Sequence: Synthetic oligonucleotide
gacgactcaaatttgagtcgtcg

SEQ ID NO: 5838 - DNA, 23 bp, Artificial Sequence
  Description of Artificial Sequence: Synthetic oligonucleotide
ggagactcaaatttgagtctccg

SEQ ID NO: 5839 - DNA, 23 bp, Artificial Sequence
  Description of Artificial Sequence: Synthetic oligonucleotide
tgcgactcaaatttgagtcgcag

SEQ ID NO: 5840 - DNA, 23 bp, Artificial Sequence
  Description of Artificial Sequence: Synthetic oligonucleotide
ggtgactcaaatttgagtcaccg

SEQ ID NO: 5841 - DNA, 23 bp, Artificial Sequence
  Description of Artificial Sequence: Synthetic oligonucleotide
acggactcaaatttgagtccgtg

SEQ ID NO: 5842 - DNA, 23 bp, Artificial Sequence
  Description of Artificial Sequence: Synthetic oligonucleotide
ccagactcaaatttgagtctggg

SEQ ID NO: 5843 - DNA, 23 bp, Artificial Sequence
  Description of Artificial Sequence: Synthetic oligonucleotide
tcggactcaaatttgagtccgag

SEQ ID NO: 5844 - DNA, 23 bp, Artificial Sequence
  Description of Artificial Sequence: Synthetic oligonucleotide
cctgactcaaatttgagtcaggg

SEQ ID NO: 5845 - DNA, 23 bp, Artificial Sequence
  Description of Artificial Sequence: Synthetic oligonucleotide
cacgactcaaatttgagtcgtgg

SEQ ID NO: 5846 - DNA, 23 bp, Artificial Sequence
  Description of Artificial Sequence: Synthetic oligonucleotide
gccgactcaaatttgagtcggct

SEQ ID NO: 5847 - DNA, 23 bp, Artificial Sequence
  Description of Artificial Sequence: Synthetic oligonucleotide
gccgactcaaatttgagtcggca

SEQ ID NO: 5848 - DNA, 23 bp, Artificial Sequence
  Description of Artificial Sequence: Synthetic oligonucleotide
cgagactcaaatttgagtctcgc

SEQ ID NO: 5849 - DNA, 23 bp, Artificial Sequence
  Description of Artificial Sequence: Synthetic oligonucleotide
cgtgactcaaatttgagtcacgc

SEQ ID NO: 5850 - DNA, 23 bp, Artificial Sequence
  Description of Artificial Sequence: Synthetic oligonucleotide
caggactcaaatttgagtcctgc

SEQ ID NO: 5851 - DNA, 23 bp, Artificial Sequence
  Description of Artificial Sequence: Synthetic oligonucleotide
ctggactcaaatttgagtccagc

SEQ ID NO: 5852 - DNA, 23 bp, Artificial Sequence
  Description of Artificial Sequence: Synthetic oligonucleotide
gaggactcaaatttgagtcctcg

SEQ ID NO: 5853 - DNA, 23 bp, Artificial Sequence
  Description of Artificial Sequence: Synthetic oligonucleotide
gtggactcaaatttgagtccacg

SEQ ID NO: 5854 - DNA, 23 bp, Artificial Sequence
  Description of Artificial Sequence: Synthetic oligonucleotide
accgactcaaatttgagtcggtg

SEQ ID NO: 5855 - DNA, 23 bp, Artificial Sequence
  Description of Artificial Sequence: Synthetic oligonucleotide
tccgactcaaatttgagtcggag

SEQ ID NO: 5856 - DNA, 23 bp, Artificial Sequence
  Description of Artificial Sequence: Synthetic oligonucleotide
cgggactcaaatttgagtcccgc

SEQ ID NO: 5857 - DNA, 23 bp, Artificial Sequence
  Description of Artificial Sequence: Synthetic oligonucleotide
agggactcaaatttgagtccctc

SEQ ID NO: 5858 - DNA, 23 bp, Artificial Sequence
  Description of Artificial Sequence: Synthetic oligonucleotide
tgggactcaaatttgagtcccac

SEQ ID NO: 5859 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaatattgagtcnnnn

SEQ ID NO: 5860 - DNA, 23 bp, Artificial Sequence
  Description of Artificial Sequence: Synthetic oligonucleotide
gcggactcaatattgagtccgcc

SEQ ID NO: 5861 - DNA, 23 bp, Artificial Sequence
  Description of Artificial Sequence: Synthetic oligonucleotide
gcggactcaatattgagtccgct

SEQ ID NO: 5862 - DNA, 23 bp, Artificial Sequence
  Description of Artificial Sequence: Synthetic oligonucleotide
acggactcaatattgagtccgtc

SEQ ID NO: 5863 - DNA, 23 bp, Artificial Sequence
  Description of Artificial Sequence: Synthetic oligonucleotide
gaggactcaatattgagtcctcc

SEQ ID NO: 5864 - DNA, 23 bp, Artificial Sequence
  Description of Artificial Sequence: Synthetic oligonucleotide
gcagactcaatattgagtctgcc

SEQ ID NO: 5865 - DNA, 23 bp, Artificial Sequence
  Description of Artificial Sequence: Synthetic oligonucleotide
gcggactcaatattgagtccgca

SEQ ID NO: 5866 - DNA, 23 bp, Artificial Sequence
  Description of Artificial Sequence: Synthetic oligonucleotide
tcggactcaatattgagtccgac

SEQ ID NO: 5867 - DNA, 23 bp, Artificial Sequence
  Description of Artificial Sequence: Synthetic oligonucleotide
gtggactcaatattgagtccacc

SEQ ID NO: 5868 - DNA, 23 bp, Artificial Sequence
  Description of Artificial Sequence: Synthetic oligonucleotide
gctgactcaatattgagtcagcc

SEQ ID NO: 5869 - DNA, 23 bp, Artificial Sequence
  Description of Artificial Sequence: Synthetic oligonucleotide
cccgactcaatattgagtcgggc

SEQ ID NO: 5870 - DNA, 23 bp, Artificial Sequence
  Description of Artificial Sequence: Synthetic oligonucleotide
cccgactcaatattgagtcgggt

SEQ ID NO: 5871 - DNA, 23 bp, Artificial Sequence
  Description of Artificial Sequence: Synthetic oligonucleotide
accgactcaatattgagtcggtc

SEQ ID NO: 5872 - DNA, 23 bp, Artificial Sequence
  Description of Artificial Sequence: Synthetic oligonucleotide
cacgactcaatattgagtcgtgc

SEQ ID NO: 5873 - DNA, 23 bp, Artificial Sequence
  Description of Artificial Sequence: Synthetic oligonucleotide
ccagactcaatattgagtctggc

SEQ ID NO: 5874 - DNA, 23 bp, Artificial Sequence
  Description of Artificial Sequence: Synthetic oligonucleotide
cccgactcaatattgagtcggga

SEQ ID NO: 5875 - DNA, 23 bp, Artificial Sequence
  Description of Artificial Sequence: Synthetic oligonucleotide
tccgactcaatattgagtcggac

SEQ ID NO: 5876 - DNA, 23 bp, Artificial Sequence
  Description of Artificial Sequence: Synthetic oligonucleotide
cctgactcaatattgagtcaggc

SEQ ID NO: 5877 - DNA, 23 bp, Artificial Sequence
  Description of Artificial Sequence: Synthetic oligonucleotide
ggcgactcaatattgagtcgccc

SEQ ID NO: 5878 - DNA, 23 bp, Artificial Sequence
  Description of Artificial Sequence: Synthetic oligonucleotide
ggcgactcaatattgagtcgcct

SEQ ID NO: 5879 - DNA, 23 bp, Artificial Sequence
  Description of Artificial Sequence: Synthetic oligonucleotide
agcgactcaatattgagtcgctc

SEQ ID NO: 5880 - DNA, 23 bp, Artificial Sequence
  Description of Artificial Sequence: Synthetic oligonucleotide
gacgactcaatattgagtcgtcc

SEQ ID NO: 5881 - DNA, 23 bp, Artificial Sequence
  Description of Artificial Sequence: Synthetic oligonucleotide
ggagactcaatattgagtctccc

SEQ ID NO: 5882 - DNA, 23 bp, Artificial Sequence
  Description of Artificial Sequence: Synthetic oligonucleotide
ggcgactcaatattgagtcgcca

SEQ ID NO: 5883 - DNA, 23 bp, Artificial Sequence
  Description of Artificial Sequence: Synthetic oligonucleotide
tgcgactcaatattgagtcgcac

SEQ ID NO: 5884 - DNA, 23 bp, Artificial Sequence
  Description of Artificial Sequence: Synthetic oligonucleotide
ggtgactcaatattgagtcaccc

SEQ ID NO: 5885 - DNA, 23 bp, Artificial Sequence
  Description of Artificial Sequence: Synthetic oligonucleotide
cgggactcaatattgagtcccgt

SEQ ID NO: 5886 - DNA, 23 bp, Artificial Sequence
  Description of Artificial Sequence: Synthetic oligonucleotide
agggactcaatattgagtccctg

SEQ ID NO: 5887 - DNA, 23 bp, Artificial Sequence
  Description of Artificial Sequence: Synthetic oligonucleotide
caggactcaatattgagtcctgg

SEQ ID NO: 5888 - DNA, 23 bp, Artificial Sequence
  Description of Artificial Sequence: Synthetic oligonucleotide
cgagactcaatattgagtctcgg

SEQ ID NO: 5889 - DNA, 23 bp, Artificial Sequence
  Description of Artificial Sequence: Synthetic oligonucleotide
cgggactcaatattgagtcccga

SEQ ID NO: 5890 - DNA, 23 bp, Artificial Sequence
  Description of Artificial Sequence: Synthetic oligonucleotide
tgggactcaatattgagtcccag

SEQ ID NO: 5891 - DNA, 23 bp, Artificial Sequence
  Description of Artificial Sequence: Synthetic oligonucleotide
ctggactcaatattgagtccagg

SEQ ID NO: 5892 - DNA, 23 bp, Artificial Sequence
  Description of Artificial Sequence: Synthetic oligonucleotide
cgtgactcaatattgagtcacgg

SEQ ID NO: 5893 - DNA, 23 bp, Artificial Sequence
  Description of Artificial Sequence: Synthetic oligonucleotide
ggcgactcaatattgagtcgccg

SEQ ID NO: 5894 - DNA, 23 bp, Artificial Sequence
  Description of Artificial Sequence: Synthetic oligonucleotide
agcgactcaatattgagtcgctg

SEQ ID NO: 5895 - DNA, 23 bp, Artificial Sequence
  Description of Artificial Sequence: Synthetic oligonucleotide
gacgactcaatattgagtcgtcg

SEQ ID NO: 5896 - DNA, 23 bp, Artificial Sequence
  Description of Artificial Sequence: Synthetic oligonucleotide
ggagactcaatattgagtctccg

SEQ ID NO: 5897 - DNA, 23 bp, Artificial Sequence
  Description of Artificial Sequence: Synthetic oligonucleotide
tgcgactcaatattgagtcgcag

SEQ ID NO: 5898 - DNA, 23 bp, Artificial Sequence
  Description of Artificial Sequence: Synthetic oligonucleotide
ggtgactcaatattgagtcaccg

SEQ ID NO: 5899 - DNA, 23 bp, Artificial Sequence
  Description of Artificial Sequence: Synthetic oligonucleotide
acggactcaatattgagtccgtg

SEQ ID NO: 5900 - DNA, 23 bp, Artificial Sequence
  Description of Artificial Sequence: Synthetic oligonucleotide
ccagactcaatattgagtctggg

SEQ ID NO: 5901 - DNA, 23 bp, Artificial Sequence
  Description of Artificial Sequence: Synthetic oligonucleotide
tcggactcaatattgagtccgag

SEQ ID NO: 5902 - DNA, 23 bp, Artificial Sequence
  Description of Artificial Sequence: Synthetic oligonucleotide
cctgactcaatattgagtcaggg

SEQ ID NO: 5903 - DNA, 23 bp, Artificial Sequence
  Description of Artificial Sequence: Synthetic oligonucleotide
cacgactcaatattgagtcgtgg

SEQ ID NO: 5904 - DNA, 23 bp, Artificial Sequence
  Description of Artificial Sequence: Synthetic oligonucleotide
gccgactcaatattgagtcggct

SEQ ID NO: 5905 - DNA, 23 bp, Artificial Sequence
  Description of Artificial Sequence: Synthetic oligonucleotide
gccgactcaatattgagtcggca

SEQ ID NO: 5906 - DNA, 23 bp, Artificial Sequence
  Description of Artificial Sequence: Synthetic oligonucleotide
cgagactcaatattgagtctcgc

SEQ ID NO: 5907 - DNA, 23 bp, Artificial Sequence
  Description of Artificial Sequence: Synthetic oligonucleotide
cgtgactcaatattgagtcacgc

SEQ ID NO: 5908 - DNA, 23 bp, Artificial Sequence
  Description of Artificial Sequence: Synthetic oligonucleotide
caggactcaatattgagtcctgc

SEQ ID NO: 5909 - DNA, 23 bp, Artificial Sequence
  Description of Artificial Sequence: Synthetic oligonucleotide
ctggactcaatattgagtccagc

SEQ ID NO: 5910 - DNA, 23 bp, Artificial Sequence
  Description of Artificial Sequence: Synthetic oligonucleotide
gaggactcaatattgagtcctcg

SEQ ID NO: 5911 - DNA, 23 bp, Artificial Sequence
  Description of Artificial Sequence: Synthetic oligonucleotide
gtggactcaatattgagtccacg

SEQ ID NO: 5912 - DNA, 23 bp, Artificial Sequence
  Description of Artificial Sequence: Synthetic oligonucleotide
accgactcaatattgagtcggtg

SEQ ID NO: 5913 - DNA, 23 bp, Artificial Sequence
  Description of Artificial Sequence: Synthetic oligonucleotide
tccgactcaatattgagtcggag

SEQ ID NO: 5914 - DNA, 23 bp, Artificial Sequence
  Description of Artificial Sequence: Synthetic oligonucleotide
cgggactcaatattgagtcccgc

SEQ ID NO: 5915 - DNA, 23 bp, Artificial Sequence
  Description of Artificial Sequence: Synthetic oligonucleotide
agggactcaatattgagtccctc

SEQ ID NO: 5916 - DNA, 23 bp, Artificial Sequence
  Description of Artificial Sequence: Synthetic oligonucleotide
tgggactcaatattgagtcccac

SEQ ID NO: 5917 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaagcttgagtcnnnn

SEQ ID NO: 5918 - DNA, 23 bp, Artificial Sequence
  Description of Artificial Sequence: Synthetic oligonucleotide
gcggactcaagcttgagtccgcc

SEQ ID NO: 5919 - DNA, 23 bp, Artificial Sequence
  Description of Artificial Sequence: Synthetic oligonucleotide
gcggactcaagcttgagtccgct

SEQ ID NO: 5920 - DNA, 23 bp, Artificial Sequence
  Description of Artificial Sequence: Synthetic oligonucleotide
acggactcaagcttgagtccgtc

SEQ ID NO: 5921 - DNA, 23 bp, Artificial Sequence
  Description of Artificial Sequence: Synthetic oligonucleotide
gaggactcaagcttgagtcctcc

SEQ ID NO: 5922 - DNA, 23 bp, Artificial Sequence
  Description of Artificial Sequence: Synthetic oligonucleotide
gcagactcaagcttgagtctgcc

SEQ ID NO: 5923 - DNA, 23 bp, Artificial Sequence
  Description of Artificial Sequence: Synthetic oligonucleotide
gcggactcaagcttgagtccgca

SEQ ID NO: 5924 - DNA, 23 bp, Artificial Sequence
  Description of Artificial Sequence: Synthetic oligonucleotide
tcggactcaagcttgagtccgac

SEQ ID NO: 5925 - DNA, 23 bp, Artificial Sequence
  Description of Artificial Sequence: Synthetic oligonucleotide
gtggactcaagcttgagtccacc

SEQ ID NO: 5926 - DNA, 23 bp, Artificial Sequence
  Description of Artificial Sequence: Synthetic oligonucleotide
gctgactcaagcttgagtcagcc

SEQ ID NO: 5927 - DNA, 23 bp, Artificial Sequence
  Description of Artificial Sequence: Synthetic oligonucleotide
cccgactcaagcttgagtcgggc

SEQ ID NO: 5928 - DNA, 23 bp, Artificial Sequence
  Description of Artificial Sequence: Synthetic oligonucleotide
cccgactcaagcttgagtcgggt

SEQ ID NO: 5929 - DNA, 23 bp, Artificial Sequence
  Description of Artificial Sequence: Synthetic oligonucleotide
accgactcaagcttgagtcggtc

SEQ ID NO: 5930 - DNA, 23 bp, Artificial Sequence
  Description of Artificial Sequence: Synthetic oligonucleotide
cacgactcaagcttgagtcgtgc

SEQ ID NO: 5931 - DNA, 23 bp, Artificial Sequence
  Description of Artificial Sequence: Synthetic oligonucleotide
ccagactcaagcttgagtctggc

SEQ ID NO: 5932 - DNA, 23 bp, Artificial Sequence
  Description of Artificial Sequence: Synthetic oligonucleotide
cccgactcaagcttgagtcggga

SEQ ID NO: 5933 - DNA, 23 bp, Artificial Sequence
  Description of Artificial Sequence: Synthetic oligonucleotide
tccgactcaagcttgagtcggac

SEQ ID NO: 5934 - DNA, 23 bp, Artificial Sequence
  Description of Artificial Sequence: Synthetic oligonucleotide
cctgactcaagcttgagtcaggc

SEQ ID NO: 5935 - DNA, 23 bp, Artificial Sequence
  Description of Artificial Sequence: Synthetic oligonucleotide
ggcgactcaagcttgagtcgccc

SEQ ID NO: 5936 - DNA, 23 bp, Artificial Sequence
  Description of Artificial Sequence: Synthetic oligonucleotide
ggcgactcaagcttgagtcgcct

SEQ ID NO: 5937 - DNA, 23 bp, Artificial Sequence
  Description of Artificial Sequence: Synthetic oligonucleotide
agcgactcaagcttgagtcgctc

SEQ ID NO: 5938 - DNA, 23 bp, Artificial Sequence
  Description of Artificial Sequence: Synthetic oligonucleotide
gacgactcaagcttgagtcgtcc

SEQ ID NO: 5939 - DNA, 23 bp, Artificial Sequence
  Description of Artificial Sequence: Synthetic oligonucleotide
ggagactcaagcttgagtctccc

SEQ ID NO: 5940 - DNA, 23 bp, Artificial Sequence
  Description of Artificial Sequence: Synthetic oligonucleotide
ggcgactcaagcttgagtcgcca

SEQ ID NO: 5941 - DNA, 23 bp, Artificial Sequence
  Description of Artificial Sequence: Synthetic oligonucleotide
tgcgactcaagcttgagtcgcac

SEQ ID NO: 5942 - DNA, 23 bp, Artificial Sequence
  Description of Artificial Sequence: Synthetic oligonucleotide
ggtgactcaagcttgagtcaccc

SEQ ID NO: 5943 - DNA, 23 bp, Artificial Sequence
  Description of Artificial Sequence: Synthetic oligonucleotide
cgggactcaagcttgagtcccgt

SEQ ID NO: 5944 - DNA, 23 bp, Artificial Sequence
  Description of Artificial Sequence: Synthetic oligonucleotide
agggactcaagcttgagtccctg

SEQ ID NO: 5945 - DNA, 23 bp, Artificial Sequence
  Description of Artificial Sequence: Synthetic oligonucleotide
caggactcaagcttgagtcctgg

SEQ ID NO: 5946 - DNA, 23 bp, Artificial Sequence
  Description of Artificial Sequence: Synthetic oligonucleotide
cgagactcaagcttgagtctcgg

SEQ ID NO: 5947 - DNA, 23 bp, Artificial Sequence
  Description of Artificial Sequence: Synthetic oligonucleotide
cgggactcaagcttgagtcccga

SEQ ID NO: 5948 - DNA, 23 bp, Artificial Sequence
  Description of Artificial Sequence: Synthetic oligonucleotide
tgggactcaagcttgagtcccag

SEQ ID NO: 5949 - DNA, 23 bp, Artificial Sequence
  Description of Artificial Sequence: Synthetic oligonucleotide
ctggactcaagcttgagtccagg

SEQ ID NO: 5950 - DNA, 23 bp, Artificial Sequence
  Description of Artificial Sequence: Synthetic oligonucleotide
cgtgactcaagcttgagtcacgg

SEQ ID NO: 5951 - DNA, 23 bp, Artificial Sequence
  Description of Artificial Sequence: Synthetic oligonucleotide
ggcgactcaagcttgagtcgccg

SEQ ID NO: 5952 - DNA, 23 bp, Artificial Sequence
  Description of Artificial Sequence: Synthetic oligonucleotide
agcgactcaagcttgagtcgctg

SEQ ID NO: 5953 - DNA, 23 bp, Artificial Sequence
  Description of Artificial Sequence: Synthetic oligonucleotide
gacgactcaagcttgagtcgtcg

SEQ ID NO: 5954 - DNA, 23 bp, Artificial Sequence
  Description of Artificial Sequence: Synthetic oligonucleotide
ggagactcaagcttgagtctccg

SEQ ID NO: 5955 - DNA, 23 bp, Artificial Sequence
  Description of Artificial Sequence: Synthetic oligonucleotide
tgcgactcaagcttgagtcgcag

SEQ ID NO: 5956 - DNA, 23 bp, Artificial Sequence
  Description of Artificial Sequence: Synthetic oligonucleotide
ggtgactcaagcttgagtcaccg

SEQ ID NO: 5957 - DNA, 23 bp, Artificial Sequence
  Description of Artificial Sequence: Synthetic oligonucleotide
acggactcaagcttgagtccgtg

SEQ ID NO: 5958 - DNA, 23 bp, Artificial Sequence
  Description of Artificial Sequence: Synthetic oligonucleotide
ccagactcaagcttgagtctggg

SEQ ID NO: 5959 - DNA, 23 bp, Artificial Sequence
  Description of Artificial Sequence: Synthetic oligonucleotide
tcggactcaagcttgagtccgag

SEQ ID NO: 5960 - DNA, 23 bp, Artificial Sequence
  Description of Artificial Sequence: Synthetic oligonucleotide
cctgactcaagcttgagtcaggg

SEQ ID NO: 5961 - DNA, 23 bp, Artificial Sequence
  Description of Artificial Sequence: Synthetic oligonucleotide
cacgactcaagcttgagtcgtgg

SEQ ID NO: 5962 - DNA, 23 bp, Artificial Sequence
  Description of Artificial Sequence: Synthetic oligonucleotide
gccgactcaagcttgagtcggct

SEQ ID NO: 5963 - DNA, 23 bp, Artificial Sequence
  Description of Artificial Sequence: Synthetic oligonucleotide
gccgactcaagcttgagtcggca

SEQ ID NO: 5964 - DNA, 23 bp, Artificial Sequence
  Description of Artificial Sequence: Synthetic oligonucleotide
cgagactcaagcttgagtctcgc

SEQ ID NO: 5965 - DNA, 23 bp, Artificial Sequence
  Description of Artificial Sequence: Synthetic oligonucleotide
cgtgactcaagcttgagtcacgc

SEQ ID NO: 5966 - DNA, 23 bp, Artificial Sequence
  Description of Artificial Sequence: Synthetic oligonucleotide
caggactcaagcttgagtcctgc

SEQ ID NO: 5967 - DNA, 23 bp, Artificial Sequence
  Description of Artificial Sequence: Synthetic oligonucleotide
ctggactcaagcttgagtccagc

SEQ ID NO: 5968 - DNA, 23 bp, Artificial Sequence
  Description of Artificial Sequence: Synthetic oligonucleotide
gaggactcaagcttgagtcctcg

SEQ ID NO: 5969 - DNA, 23 bp, Artificial Sequence
  Description of Artificial Sequence: Synthetic oligonucleotide
gtggactcaagcttgagtccacg

SEQ ID NO: 5970 - DNA, 23 bp, Artificial Sequence
  Description of Artificial Sequence: Synthetic oligonucleotide
accgactcaagcttgagtcggtg

SEQ ID NO: 5971 - DNA, 23 bp, Artificial Sequence
  Description of Artificial Sequence: Synthetic oligonucleotide
tccgactcaagcttgagtcggag

SEQ ID NO: 5972 - DNA, 23 bp, Artificial Sequence
  Description of Artificial Sequence: Synthetic oligonucleotide
cgggactcaagcttgagtcccgc

SEQ ID NO: 5973 - DNA, 23 bp, Artificial Sequence
  Description of Artificial Sequence: Synthetic oligonucleotide
agggactcaagcttgagtccctc

SEQ ID NO: 5974 - DNA, 23 bp, Artificial Sequence
  Description of Artificial Sequence: Synthetic oligonucleotide
tgggactcaagcttgagtcccac

SEQ ID NO: 5975 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcaacgttgagtcnnnn

SEQ ID NO: 5976 - DNA, 23 bp, Artificial Sequence
  Description of Artificial Sequence: Synthetic oligonucleotide
gcggactcaacgttgagtccgcc

SEQ ID NO: 5977 - DNA, 23 bp, Artificial Sequence
  Description of Artificial Sequence: Synthetic oligonucleotide
gcggactcaacgttgagtccgct

SEQ ID NO: 5978 - DNA, 23 bp, Artificial Sequence
  Description of Artificial Sequence: Synthetic oligonucleotide
acggactcaacgttgagtccgtc

SEQ ID NO: 5979 - DNA, 23 bp, Artificial Sequence
  Description of Artificial Sequence: Synthetic oligonucleotide
gaggactcaacgttgagtcctcc

SEQ ID NO: 5980 - DNA, 23 bp, Artificial Sequence
  Description of Artificial Sequence: Synthetic oligonucleotide
gcagactcaacgttgagtctgcc

SEQ ID NO: 5981 - DNA, 23 bp, Artificial Sequence
  Description of Artificial Sequence: Synthetic oligonucleotide
gcggactcaacgttgagtccgca

SEQ ID NO: 5982 - DNA, 23 bp, Artificial Sequence
  Description of Artificial Sequence: Synthetic oligonucleotide
tcggactcaacgttgagtccgac

SEQ ID NO: 5983 - DNA, 23 bp, Artificial Sequence
  Description of Artificial Sequence: Synthetic oligonucleotide
gtggactcaacgttgagtccacc

SEQ ID NO: 5984 - DNA, 23 bp, Artificial Sequence
  Description of Artificial Sequence: Synthetic oligonucleotide
gctgactcaacgttgagtcagcc

SEQ ID NO: 5985 - DNA, 23 bp, Artificial Sequence
  Description of Artificial Sequence: Synthetic oligonucleotide
cccgactcaacgttgagtcgggc

SEQ ID NO: 5986 - DNA, 23 bp, Artificial Sequence
  Description of Artificial Sequence: Synthetic oligonucleotide
cccgactcaacgttgagtcgggt

SEQ ID NO: 5987 - DNA, 23 bp, Artificial Sequence
  Description of Artificial Sequence: Synthetic oligonucleotide
accgactcaacgttgagtcggtc

SEQ ID NO: 5988 - DNA, 23 bp, Artificial Sequence
  Description of Artificial Sequence: Synthetic oligonucleotide
cacgactcaacgttgagtcgtgc

SEQ ID NO: 5989 - DNA, 23 bp, Artificial Sequence
  Description of Artificial Sequence: Synthetic oligonucleotide
ccagactcaacgttgagtctggc

SEQ ID NO: 5990 - DNA, 23 bp, Artificial Sequence
  Description of Artificial Sequence: Synthetic oligonucleotide
cccgactcaacgttgagtcggga

SEQ ID NO: 5991 - DNA, 23 bp, Artificial Sequence
  Description of Artificial Sequence: Synthetic oligonucleotide
tccgactcaacgttgagtcggac

SEQ ID NO: 5992 - DNA, 23 bp, Artificial Sequence
  Description of Artificial Sequence: Synthetic oligonucleotide
cctgactcaacgttgagtcaggc

SEQ ID NO: 5993 - DNA, 23 bp, Artificial Sequence
  Description of Artificial Sequence: Synthetic oligonucleotide
ggcgactcaacgttgagtcgccc

SEQ ID NO: 5994 - DNA, 23 bp, Artificial Sequence
  Description of Artificial Sequence: Synthetic oligonucleotide
ggcgactcaacgttgagtcgcct

SEQ ID NO: 5995 - DNA, 23 bp, Artificial Sequence
  Description of Artificial Sequence: Synthetic oligonucleotide
agcgactcaacgttgagtcgctc

SEQ ID NO: 5996 - DNA, 23 bp, Artificial Sequence
  Description of Artificial Sequence: Synthetic oligonucleotide
gacgactcaacgttgagtcgtcc

SEQ ID NO: 5997 - DNA, 23 bp, Artificial Sequence
  Description of Artificial Sequence: Synthetic oligonucleotide
ggagactcaacgttgagtctccc

SEQ ID NO: 5998 - DNA, 23 bp, Artificial Sequence
  Description of Artificial Sequence: Synthetic oligonucleotide
ggcgactcaacgttgagtcgcca

SEQ ID NO: 5999 - DNA, 23 bp, Artificial Sequence
  Description of Artificial Sequence: Synthetic oligonucleotide
tgcgactcaacgttgagtcgcac

SEQ ID NO: 6000 - DNA, 23 bp, Artificial Sequence
  Description of Artificial Sequence: Synthetic oligonucleotide
ggtgactcaacgttgagtcaccc

SEQ ID NO: 6001 - DNA, 23 bp, Artificial Sequence
  Description of Artificial Sequence: Synthetic oligonucleotide
cgggactcaacgttgagtcccgt

SEQ ID NO: 6002 - DNA, 23 bp, Artificial Sequence
  Description of Artificial Sequence: Synthetic oligonucleotide
agggactcaacgttgagtccctg

SEQ ID NO: 6003 - DNA, 23 bp, Artificial Sequence
  Description of Artificial Sequence: Synthetic oligonucleotide
caggactcaacgttgagtcctgg

SEQ ID NO: 6004 - DNA, 23 bp, Artificial Sequence
  Description of Artificial Sequence: Synthetic oligonucleotide
cgagactcaacgttgagtctcgg

SEQ ID NO: 6005 - DNA, 23 bp, Artificial Sequence
  Description of Artificial Sequence: Synthetic oligonucleotide
cgggactcaacgttgagtcccga

SEQ ID NO: 6006 - DNA, 23 bp, Artificial Sequence
  Description of Artificial Sequence: Synthetic oligonucleotide
tgggactcaacgttgagtcccag

SEQ ID NO: 6007 - DNA, 23 bp, Artificial Sequence
  Description of Artificial Sequence: Synthetic oligonucleotide
ctggactcaacgttgagtccagg

SEQ ID NO: 6008 - DNA, 23 bp, Artificial Sequence
  Description of Artificial Sequence: Synthetic oligonucleotide
cgtgactcaacgttgagtcacgg

SEQ ID NO: 6009 - DNA, 23 bp, Artificial Sequence
  Description of Artificial Sequence: Synthetic oligonucleotide
ggcgactcaacgttgagtcgccg

SEQ ID NO: 6010 - DNA, 23 bp, Artificial Sequence
  Description of Artificial Sequence: Synthetic oligonucleotide
agcgactcaacgttgagtcgctg

SEQ ID NO: 6011 - DNA, 23 bp, Artificial Sequence
  Description of Artificial Sequence: Synthetic oligonucleotide
gacgactcaacgttgagtcgtcg

SEQ ID NO: 6012 - DNA, 23 bp, Artificial Sequence
  Description of Artificial Sequence: Synthetic oligonucleotide
ggagactcaacgttgagtctccg

SEQ ID NO: 6013 - DNA, 23 bp, Artificial Sequence
  Description of Artificial Sequence: Synthetic oligonucleotide
tgcgactcaacgttgagtcgcag

SEQ ID NO: 6014 - DNA, 23 bp, Artificial Sequence
  Description of Artificial Sequence: Synthetic oligonucleotide
ggtgactcaacgttgagtcaccg

SEQ ID NO: 6015 - DNA, 23 bp, Artificial Sequence
  Description of Artificial Sequence: Synthetic oligonucleotide
acggactcaacgttgagtccgtg

SEQ ID NO: 6016 - DNA, 23 bp, Artificial Sequence
  Description of Artificial Sequence: Synthetic oligonucleotide
ccagactcaacgttgagtctggg

SEQ ID NO: 6017 - DNA, 23 bp, Artificial Sequence
  Description of Artificial Sequence: Synthetic oligonucleotide
tcggactcaacgttgagtccgag

SEQ ID NO: 6018 - DNA, 23 bp, Artificial Sequence
  Description of Artificial Sequence: Synthetic oligonucleotide
cctgactcaacgttgagtcaggg

SEQ ID NO: 6019 - DNA, 23 bp, Artificial Sequence
  Description of Artificial Sequence: Synthetic oligonucleotide
cacgactcaacgttgagtcgtgg

SEQ ID NO: 6020 - DNA, 23 bp, Artificial Sequence
  Description of Artificial Sequence: Synthetic oligonucleotide
gccgactcaacgttgagtcggct

SEQ ID NO: 6021 - DNA, 23 bp, Artificial Sequence
  Description of Artificial Sequence: Synthetic oligonucleotide
gccgactcaacgttgagtcggca

SEQ ID NO: 6022 - DNA, 23 bp, Artificial Sequence
  Description of Artificial Sequence: Synthetic oligonucleotide
cgagactcaacgttgagtctcgc

SEQ ID NO: 6023 - DNA, 23 bp, Artificial Sequence
  Description of Artificial Sequence: Synthetic oligonucleotide
cgtgactcaacgttgagtcacgc

SEQ ID NO: 6024 - DNA, 23 bp, Artificial Sequence
  Description of Artificial Sequence: Synthetic oligonucleotide
caggactcaacgttgagtcctgc

SEQ ID NO: 6025 - DNA, 23 bp, Artificial Sequence
  Description of Artificial Sequence: Synthetic oligonucleotide
ctggactcaacgttgagtccagc

SEQ ID NO: 6026 - DNA, 23 bp, Artificial Sequence
  Description of Artificial Sequence: Synthetic oligonucleotide
gaggactcaacgttgagtcctcg

SEQ ID NO: 6027 - DNA, 23 bp, Artificial Sequence
  Description of Artificial Sequence: Synthetic oligonucleotide
gtggactcaacgttgagtccacg

SEQ ID NO: 6028 - DNA, 23 bp, Artificial Sequence
  Description of Artificial Sequence: Synthetic oligonucleotide
accgactcaacgttgagtcggtg

SEQ ID NO: 6029 - DNA, 23 bp, Artificial Sequence
  Description of Artificial Sequence: Synthetic oligonucleotide
tccgactcaacgttgagtcggag

SEQ ID NO: 6030 - DNA, 23 bp, Artificial Sequence
  Description of Artificial Sequence: Synthetic oligonucleotide
cgggactcaacgttgagtcccgc

SEQ ID NO: 6031 - DNA, 23 bp, Artificial Sequence
  Description of Artificial Sequence: Synthetic oligonucleotide
agggactcaacgttgagtccctc

SEQ ID NO: 6032 - DNA, 23 bp, Artificial Sequence
  Description of Artificial Sequence: Synthetic oligonucleotide
tgggactcaacgttgagtcccac

SEQ ID NO: 6033 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctaattagagtcnnnn

SEQ ID NO: 6034 - DNA, 23 bp, Artificial Sequence
  Description of Artificial Sequence: Synthetic oligonucleotide
gcggactctaattagagtccgcc

SEQ ID NO: 6035 - DNA, 23 bp, Artificial Sequence
  Description of Artificial Sequence: Synthetic oligonucleotide
gcggactctaattagagtccgct

SEQ ID NO: 6036 - DNA, 23 bp, Artificial Sequence
  Description of Artificial Sequence: Synthetic oligonucleotide
acggactctaattagagtccgtc

SEQ ID NO: 6037 - DNA, 23 bp, Artificial Sequence
  Description of Artificial Sequence: Synthetic oligonucleotide
gaggactctaattagagtcctcc

SEQ ID NO: 6038 - DNA, 23 bp, Artificial Sequence
  Description of Artificial Sequence: Synthetic oligonucleotide
gcagactctaattagagtctgcc

SEQ ID NO: 6039 - DNA, 23 bp, Artificial Sequence
  Description of Artificial Sequence: Synthetic oligonucleotide
gcggactctaattagagtccgca

SEQ ID NO: 6040 - DNA, 23 bp, Artificial Sequence
  Description of Artificial Sequence: Synthetic oligonucleotide
tcggactctaattagagtccgac

SEQ ID NO: 6041 - DNA, 23 bp, Artificial Sequence
  Description of Artificial Sequence: Synthetic oligonucleotide
gtggactctaattagagtccacc

SEQ ID NO: 6042 - DNA, 23 bp, Artificial Sequence
  Description of Artificial Sequence: Synthetic oligonucleotide
gctgactctaattagagtcagcc

SEQ ID NO: 6043 - DNA, 23 bp, Artificial Sequence
  Description of Artificial Sequence: Synthetic oligonucleotide
cccgactctaattagagtcgggc

SEQ ID NO: 6044 - DNA, 23 bp, Artificial Sequence
  Description of Artificial Sequence: Synthetic oligonucleotide
cccgactctaattagagtcgggt

SEQ ID NO: 6045 - DNA, 23 bp, Artificial Sequence
  Description of Artificial Sequence: Synthetic oligonucleotide
accgactctaattagagtcggtc

SEQ ID NO: 6046 - DNA, 23 bp, Artificial Sequence
  Description of Artificial Sequence: Synthetic oligonucleotide
cacgactctaattagagtcgtgc

SEQ ID NO: 6047 - DNA, 23 bp, Artificial Sequence
  Description of Artificial Sequence: Synthetic oligonucleotide
ccagactctaattagagtctggc

SEQ ID NO: 6048 - DNA, 23 bp, Artificial Sequence
  Description of Artificial Sequence: Synthetic oligonucleotide
cccgactctaattagagtcggga

SEQ ID NO: 6049 - DNA, 23 bp, Artificial Sequence
  Description of Artificial Sequence: Synthetic oligonucleotide
tccgactctaattagagtcggac

SEQ ID NO: 6050 - DNA, 23 bp, Artificial Sequence
  Description of Artificial Sequence: Synthetic oligonucleotide
cctgactctaattagagtcaggc

SEQ ID NO: 6051 - DNA, 23 bp, Artificial Sequence
  Description of Artificial Sequence: Synthetic oligonucleotide
ggcgactctaattagagtcgccc

SEQ ID NO: 6052 - DNA, 23 bp, Artificial Sequence
  Description of Artificial Sequence: Synthetic oligonucleotide
ggcgactctaattagagtcgcct

SEQ ID NO: 6053 - DNA, 23 bp, Artificial Sequence
  Description of Artificial Sequence: Synthetic oligonucleotide
agcgactctaattagagtcgctc

SEQ ID NO: 6054 - DNA, 23 bp, Artificial Sequence
  Description of Artificial Sequence: Synthetic oligonucleotide
gacgactctaattagagtcgtcc

SEQ ID NO: 6055 - DNA, 23 bp, Artificial Sequence
  Description of Artificial Sequence: Synthetic oligonucleotide
ggagactctaattagagtctccc

SEQ ID NO: 6056 - DNA, 23 bp, Artificial Sequence
  Description of Artificial Sequence: Synthetic oligonucleotide
ggcgactctaattagagtcgcca

SEQ ID NO: 6057 - DNA, 23 bp, Artificial Sequence
  Description of Artificial Sequence: Synthetic oligonucleotide
tgcgactctaattagagtcgcac

SEQ ID NO: 6058 - DNA, 23 bp, Artificial Sequence
  Description of Artificial Sequence: Synthetic oligonucleotide
ggtgactctaattagagtcaccc

SEQ ID NO: 6059 - DNA, 23 bp, Artificial Sequence
  Description of Artificial Sequence: Synthetic oligonucleotide
cgggactctaattagagtcccgt

SEQ ID NO: 6060 - DNA, 23 bp, Artificial Sequence
  Description of Artificial Sequence: Synthetic oligonucleotide
agggactctaattagagtccctg

SEQ ID NO: 6061 - DNA, 23 bp, Artificial Sequence
  Description of Artificial Sequence: Synthetic oligonucleotide
caggactctaattagagtcctgg

SEQ ID NO: 6062 - DNA, 23 bp, Artificial Sequence
  Description of Artificial Sequence: Synthetic oligonucleotide
cgagactctaattagagtctcgg

SEQ ID NO: 6063 - DNA, 23 bp, Artificial Sequence
  Description of Artificial Sequence: Synthetic oligonucleotide
cgggactctaattagagtcccga

SEQ ID NO: 6064 - DNA, 23 bp, Artificial Sequence
  Description of Artificial Sequence: Synthetic oligonucleotide
tgggactctaattagagtcccag

SEQ ID NO: 6065 - DNA, 23 bp, Artificial Sequence
  Description of Artificial Sequence: Synthetic oligonucleotide
ctggactctaattagagtccagg

SEQ ID NO: 6066 - DNA, 23 bp, Artificial Sequence
  Description of Artificial Sequence: Synthetic oligonucleotide
cgtgactctaattagagtcacgg

SEQ ID NO: 6067 - DNA, 23 bp, Artificial Sequence
  Description of Artificial Sequence: Synthetic oligonucleotide
ggcgactctaattagagtcgccg

SEQ ID NO: 6068 - DNA, 23 bp, Artificial Sequence
  Description of Artificial Sequence: Synthetic oligonucleotide
agcgactctaattagagtcgctg

SEQ ID NO: 6069 - DNA, 23 bp, Artificial Sequence
  Description of Artificial Sequence: Synthetic oligonucleotide
gacgactctaattagagtcgtcg

SEQ ID NO: 6070 - DNA, 23 bp, Artificial Sequence
  Description of Artificial Sequence: Synthetic oligonucleotide
ggagactctaattagagtctccg

SEQ ID NO: 6071 - DNA, 23 bp, Artificial Sequence
  Description of Artificial Sequence: Synthetic oligonucleotide
tgcgactctaattagagtcgcag

SEQ ID NO: 6072 - DNA, 23 bp, Artificial Sequence
  Description of Artificial Sequence: Synthetic oligonucleotide
ggtgactctaattagagtcaccg

SEQ ID NO: 6073 - DNA, 23 bp, Artificial Sequence
  Description of Artificial Sequence: Synthetic oligonucleotide
acggactctaattagagtccgtg

SEQ ID NO: 6074 - DNA, 23 bp, Artificial Sequence
  Description of Artificial Sequence: Synthetic oligonucleotide
ccagactctaattagagtctggg

SEQ ID NO: 6075 - DNA, 23 bp, Artificial Sequence
  Description of Artificial Sequence: Synthetic oligonucleotide
tcggactctaattagagtccgag

SEQ ID NO: 6076 - DNA, 23 bp, Artificial Sequence
  Description of Artificial Sequence: Synthetic oligonucleotide
cctgactctaattagagtcaggg

SEQ ID NO: 6077 - DNA, 23 bp, Artificial Sequence
  Description of Artificial Sequence: Synthetic oligonucleotide
cacgactctaattagagtcgtgg

SEQ ID NO: 6078 - DNA, 23 bp, Artificial Sequence
  Description of Artificial Sequence: Synthetic oligonucleotide
gccgactctaattagagtcggct

SEQ ID NO: 6079 - DNA, 23 bp, Artificial Sequence
  Description of Artificial Sequence: Synthetic oligonucleotide
gccgactctaattagagtcggca

SEQ ID NO: 6080 - DNA, 23 bp, Artificial Sequence
  Description of Artificial Sequence: Synthetic oligonucleotide
cgagactctaattagagtctcgc

SEQ ID NO: 6081 - DNA, 23 bp, Artificial Sequence
  Description of Artificial Sequence: Synthetic oligonucleotide
cgtgactctaattagagtcacgc

SEQ ID NO: 6082 - DNA, 23 bp, Artificial Sequence
  Description of Artificial Sequence: Synthetic oligonucleotide
caggactctaattagagtcctgc

SEQ ID NO: 6083 - DNA, 23 bp, Artificial Sequence
  Description of Artificial Sequence: Synthetic oligonucleotide
ctggactctaattagagtccagc

SEQ ID NO: 6084 - DNA, 23 bp, Artificial Sequence
  Description of Artificial Sequence: Synthetic oligonucleotide
gaggactctaattagagtcctcg

SEQ ID NO: 6085 - DNA, 23 bp, Artificial Sequence
  Description of Artificial Sequence: Synthetic oligonucleotide
gtggactctaattagagtccacg

SEQ ID NO: 6086 - DNA, 23 bp, Artificial Sequence
  Description of Artificial Sequence: Synthetic oligonucleotide
accgactctaattagagtcggtg

SEQ ID NO: 6087 - DNA, 23 bp, Artificial Sequence
  Description of Artificial Sequence: Synthetic oligonucleotide
tccgactctaattagagtcggag

SEQ ID NO: 6088 - DNA, 23 bp, Artificial Sequence
  Description of Artificial Sequence: Synthetic oligonucleotide
cgggactctaattagagtcccgc

SEQ ID NO: 6089 - DNA, 23 bp, Artificial Sequence
  Description of Artificial Sequence: Synthetic oligonucleotide
agggactctaattagagtccctc

SEQ ID NO: 6090 - DNA, 23 bp, Artificial Sequence
  Description of Artificial Sequence: Synthetic oligonucleotide
tgggactctaattagagtcccac

SEQ ID NO: 6091 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctatatagagtcnnnn

SEQ ID NO: 6092 - DNA, 23 bp, Artificial Sequence
  Description of Artificial Sequence: Synthetic oligonucleotide
gcggactctatatagagtccgcc

SEQ ID NO: 6093 - DNA, 23 bp, Artificial Sequence
  Description of Artificial Sequence: Synthetic oligonucleotide
gcggactctatatagagtccgct

SEQ ID NO: 6094 - DNA, 23 bp, Artificial Sequence
  Description of Artificial Sequence: Synthetic oligonucleotide
acggactctatatagagtccgtc

SEQ ID NO: 6095 - DNA, 23 bp, Artificial Sequence
  Description of Artificial Sequence: Synthetic oligonucleotide
gaggactctatatagagtcctcc

SEQ ID NO: 6096 - DNA, 23 bp, Artificial Sequence
  Description of Artificial Sequence: Synthetic oligonucleotide
gcagactctatatagagtctgcc

SEQ ID NO: 6097 - DNA, 23 bp, Artificial Sequence
  Description of Artificial Sequence: Synthetic oligonucleotide
gcggactctatatagagtccgca

SEQ ID NO: 6098 - DNA, 23 bp, Artificial Sequence
  Description of Artificial Sequence: Synthetic oligonucleotide
tcggactctatatagagtccgac

SEQ ID NO: 6099 - DNA, 23 bp, Artificial Sequence
  Description of Artificial Sequence: Synthetic oligonucleotide
gtggactctatatagagtccacc

SEQ ID NO: 6100 - DNA, 23 bp, Artificial Sequence
  Description of Artificial Sequence: Synthetic oligonucleotide
gctgactctatatagagtcagcc

SEQ ID NO: 6101 - DNA, 23 bp, Artificial Sequence
  Description of Artificial Sequence: Synthetic oligonucleotide
cccgactctatatagagtcgggc

SEQ ID NO: 6102 - DNA, 23 bp, Artificial Sequence
  Description of Artificial Sequence: Synthetic oligonucleotide
cccgactctatatagagtcgggt

SEQ ID NO: 6103 - DNA, 23 bp, Artificial Sequence
  Description of Artificial Sequence: Synthetic oligonucleotide
accgactctatatagagtcggtc

SEQ ID NO: 6104 - DNA, 23 bp, Artificial Sequence
  Description of Artificial Sequence: Synthetic oligonucleotide
cacgactctatatagagtcgtgc

SEQ ID NO: 6105 - DNA, 23 bp, Artificial Sequence
  Description of Artificial Sequence: Synthetic oligonucleotide
ccagactctatatagagtctggc

SEQ ID NO: 6106 - DNA, 23 bp, Artificial Sequence
  Description of Artificial Sequence: Synthetic oligonucleotide
cccgactctatatagagtcggga

SEQ ID NO: 6107 - DNA, 23 bp, Artificial Sequence
  Description of Artificial Sequence: Synthetic oligonucleotide
tccgactctatatagagtcggac

SEQ ID NO: 6108 - DNA, 23 bp, Artificial Sequence
  Description of Artificial Sequence: Synthetic oligonucleotide
cctgactctatatagagtcaggc

SEQ ID NO: 6109 - DNA, 23 bp, Artificial Sequence
  Description of Artificial Sequence: Synthetic oligonucleotide
ggcgactctatatagagtcgccc

SEQ ID NO: 6110 - DNA, 23 bp, Artificial Sequence
  Description of Artificial Sequence: Synthetic oligonucleotide
ggcgactctatatagagtcgcct

SEQ ID NO: 6111 - DNA, 23 bp, Artificial Sequence
  Description of Artificial Sequence: Synthetic oligonucleotide
agcgactctatatagagtcgctc

SEQ ID NO: 6112 - DNA, 23 bp, Artificial Sequence
  Description of Artificial Sequence: Synthetic oligonucleotide
gacgactctatatagagtcgtcc

SEQ ID NO: 6113 - DNA, 23 bp, Artificial Sequence
  Description of Artificial Sequence: Synthetic oligonucleotide
ggagactctatatagagtctccc

SEQ ID NO: 6114 - DNA, 23 bp, Artificial Sequence
  Description of Artificial Sequence: Synthetic oligonucleotide
ggcgactctatatagagtcgcca

SEQ ID NO: 6115 - DNA, 23 bp, Artificial Sequence
  Description of Artificial Sequence: Synthetic oligonucleotide
tgcgactctatatagagtcgcac

SEQ ID NO: 6116 - DNA, 23 bp, Artificial Sequence
  Description of Artificial Sequence: Synthetic oligonucleotide
ggtgactctatatagagtcaccc

SEQ ID NO: 6117 - DNA, 23 bp, Artificial Sequence
  Description of Artificial Sequence: Synthetic oligonucleotide
cgggactctatatagagtcccgt

SEQ ID NO: 6118 - DNA, 23 bp, Artificial Sequence
  Description of Artificial Sequence: Synthetic oligonucleotide
agggactctatatagagtccctg

SEQ ID NO: 6119 - DNA, 23 bp, Artificial Sequence
  Description of Artificial Sequence: Synthetic oligonucleotide
caggactctatatagagtcctgg

SEQ ID NO: 6120 - DNA, 23 bp, Artificial Sequence
  Description of Artificial Sequence: Synthetic oligonucleotide
cgagactctatatagagtctcgg

SEQ ID NO: 6121 - DNA, 23 bp, Artificial Sequence
  Description of Artificial Sequence: Synthetic oligonucleotide
cgggactctatatagagtcccga

SEQ ID NO: 6122 - DNA, 23 bp, Artificial Sequence
  Description of Artificial Sequence: Synthetic oligonucleotide
tgggactctatatagagtcccag

SEQ ID NO: 6123 - DNA, 23 bp, Artificial Sequence
  Description of Artificial Sequence: Synthetic oligonucleotide
ctggactctatatagagtccagg

SEQ ID NO: 6124 - DNA, 23 bp, Artificial Sequence
  Description of Artificial Sequence: Synthetic oligonucleotide
cgtgactctatatagagtcacgg

SEQ ID NO: 6125 - DNA, 23 bp, Artificial Sequence
  Description of Artificial Sequence: Synthetic oligonucleotide
ggcgactctatatagagtcgccg

SEQ ID NO: 6126 - DNA, 23 bp, Artificial Sequence
  Description of Artificial Sequence: Synthetic oligonucleotide
agcgactctatatagagtcgctg

SEQ ID NO: 6127 - DNA, 23 bp, Artificial Sequence
  Description of Artificial Sequence: Synthetic oligonucleotide
gacgactctatatagagtcgtcg

SEQ ID NO: 6128 - DNA, 23 bp, Artificial Sequence
  Description of Artificial Sequence: Synthetic oligonucleotide
ggagactctatatagagtctccg

SEQ ID NO: 6129 - DNA, 23 bp, Artificial Sequence
  Description of Artificial Sequence: Synthetic oligonucleotide
tgcgactctatatagagtcgcag

SEQ ID NO: 6130 - DNA, 23 bp, Artificial Sequence
  Description of Artificial Sequence: Synthetic oligonucleotide
ggtgactctatatagagtcaccg

SEQ ID NO: 6131 - DNA, 23 bp, Artificial Sequence
  Description of Artificial Sequence: Synthetic oligonucleotide
acggactctatatagagtccgtg

SEQ ID NO: 6132 - DNA, 23 bp, Artificial Sequence
  Description of Artificial Sequence: Synthetic oligonucleotide
ccagactctatatagagtctggg

SEQ ID NO: 6133 - DNA, 23 bp, Artificial Sequence
  Description of Artificial Sequence: Synthetic oligonucleotide
tcggactctatatagagtccgag

SEQ ID NO: 6134 - DNA, 23 bp, Artificial Sequence
  Description of Artificial Sequence: Synthetic oligonucleotide
cctgactctatatagagtcaggg

SEQ ID NO: 6135 - DNA, 23 bp, Artificial Sequence
  Description of Artificial Sequence: Synthetic oligonucleotide
cacgactctatatagagtcgtgg

SEQ ID NO: 6136 - DNA, 23 bp, Artificial Sequence
  Description of Artificial Sequence: Synthetic oligonucleotide
gccgactctatatagagtcggct

SEQ ID NO: 6137 - DNA, 23 bp, Artificial Sequence
  Description of Artificial Sequence: Synthetic oligonucleotide
gccgactctatatagagtcggca

SEQ ID NO: 6138 - DNA, 23 bp, Artificial Sequence
  Description of Artificial Sequence: Synthetic oligonucleotide
cgagactctatatagagtctcgc

SEQ ID NO: 6139 - DNA, 23 bp, Artificial Sequence
  Description of Artificial Sequence: Synthetic oligonucleotide
cgtgactctatatagagtcacgc

SEQ ID NO: 6140 - DNA, 23 bp, Artificial Sequence
  Description of Artificial Sequence: Synthetic oligonucleotide
caggactctatatagagtcctgc

SEQ ID NO: 6141 - DNA, 23 bp, Artificial Sequence
  Description of Artificial Sequence: Synthetic oligonucleotide
ctggactctatatagagtccagc

SEQ ID NO: 6142 - DNA, 23 bp, Artificial Sequence
  Description of Artificial Sequence: Synthetic oligonucleotide
gaggactctatatagagtcctcg

SEQ ID NO: 6143 - DNA, 23 bp, Artificial Sequence
  Description of Artificial Sequence: Synthetic oligonucleotide
gtggactctatatagagtccacg

SEQ ID NO: 6144 - DNA, 23 bp, Artificial Sequence
  Description of Artificial Sequence: Synthetic oligonucleotide
accgactctatatagagtcggtg

SEQ ID NO: 6145 - DNA, 23 bp, Artificial Sequence
  Description of Artificial Sequence: Synthetic oligonucleotide
tccgactctatatagagtcggag

SEQ ID NO: 6146 - DNA, 23 bp, Artificial Sequence
  Description of Artificial Sequence: Synthetic oligonucleotide
cgggactctatatagagtcccgc

SEQ ID NO: 6147 - DNA, 23 bp, Artificial Sequence
  Description of Artificial Sequence: Synthetic oligonucleotide
agggactctatatagagtccctc

SEQ ID NO: 6148 - DNA, 23 bp, Artificial Sequence
  Description of Artificial Sequence: Synthetic oligonucleotide
tgggactctatatagagtcccac

SEQ ID NO: 6149 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctagctagagtcnnnn

SEQ ID NO: 6150 - DNA, 23 bp, Artificial Sequence
  Description of Artificial Sequence: Synthetic oligonucleotide
gcggactctagctagagtccgcc

SEQ ID NO: 6151 - DNA, 23 bp, Artificial Sequence
  Description of Artificial Sequence: Synthetic oligonucleotide
gcggactctagctagagtccgct

SEQ ID NO: 6152 - DNA, 23 bp, Artificial Sequence
  Description of Artificial Sequence: Synthetic oligonucleotide
acggactctagctagagtccgtc

SEQ ID NO: 6153 - DNA, 23 bp, Artificial Sequence
  Description of Artificial Sequence: Synthetic oligonucleotide
gaggactctagctagagtcctcc

SEQ ID NO: 6154 - DNA, 23 bp, Artificial Sequence
  Description of Artificial Sequence: Synthetic oligonucleotide
gcagactctagctagagtctgcc

SEQ ID NO: 6155 - DNA, 23 bp, Artificial Sequence
  Description of Artificial Sequence: Synthetic oligonucleotide
gcggactctagctagagtccgca

SEQ ID NO: 6156 - DNA, 23 bp, Artificial Sequence
  Description of Artificial Sequence: Synthetic oligonucleotide
tcggactctagctagagtccgac

SEQ ID NO: 6157 - DNA, 23 bp, Artificial Sequence
  Description of Artificial Sequence: Synthetic oligonucleotide
gtggactctagctagagtccacc

SEQ ID NO: 6158 - DNA, 23 bp, Artificial Sequence
  Description of Artificial Sequence: Synthetic oligonucleotide
gctgactctagctagagtcagcc

SEQ ID NO: 6159 - DNA, 23 bp, Artificial Sequence
  Description of Artificial Sequence: Synthetic oligonucleotide
cccgactctagctagagtcgggc

SEQ ID NO: 6160 - DNA, 23 bp, Artificial Sequence
  Description of Artificial Sequence: Synthetic oligonucleotide
cccgactctagctagagtcgggt

SEQ ID NO: 6161 - DNA, 23 bp, Artificial Sequence
  Description of Artificial Sequence: Synthetic oligonucleotide
accgactctagctagagtcggtc

SEQ ID NO: 6162 - DNA, 23 bp, Artificial Sequence
  Description of Artificial Sequence: Synthetic oligonucleotide
cacgactctagctagagtcgtgc

SEQ ID NO: 6163 - DNA, 23 bp, Artificial Sequence
  Description of Artificial Sequence: Synthetic oligonucleotide
ccagactctagctagagtctggc

SEQ ID NO: 6164 - DNA, 23 bp, Artificial Sequence
  Description of Artificial Sequence: Synthetic oligonucleotide
cccgactctagctagagtcggga

SEQ ID NO: 6165 - DNA, 23 bp, Artificial Sequence
  Description of Artificial Sequence: Synthetic oligonucleotide
tccgactctagctagagtcggac

SEQ ID NO: 6166 - DNA, 23 bp, Artificial Sequence
  Description of Artificial Sequence: Synthetic oligonucleotide
cctgactctagctagagtcaggc

SEQ ID NO: 6167 - DNA, 23 bp, Artificial Sequence
  Description of Artificial Sequence: Synthetic oligonucleotide
ggcgactctagctagagtcgccc

SEQ ID NO: 6168 - DNA, 23 bp, Artificial Sequence
  Description of Artificial Sequence: Synthetic oligonucleotide
ggcgactctagctagagtcgcct

SEQ ID NO: 6169 - DNA, 23 bp, Artificial Sequence
  Description of Artificial Sequence: Synthetic oligonucleotide
agcgactctagctagagtcgctc

SEQ ID NO: 6170 - DNA, 23 bp, Artificial Sequence
  Description of Artificial Sequence: Synthetic oligonucleotide
gacgactctagctagagtcgtcc

SEQ ID NO: 6171 - DNA, 23 bp, Artificial Sequence
  Description of Artificial Sequence: Synthetic oligonucleotide
ggagactctagctagagtctccc

SEQ ID NO: 6172 - DNA, 23 bp, Artificial Sequence
  Description of Artificial Sequence: Synthetic oligonucleotide
ggcgactctagctagagtcgcca

SEQ ID NO: 6173 - DNA, 23 bp, Artificial Sequence
  Description of Artificial Sequence: Synthetic oligonucleotide
tgcgactctagctagagtcgcac

SEQ ID NO: 6174 - DNA, 23 bp, Artificial Sequence
  Description of Artificial Sequence: Synthetic oligonucleotide
ggtgactctagctagagtcaccc

SEQ ID NO: 6175 - DNA, 23 bp, Artificial Sequence
  Description of Artificial Sequence: Synthetic oligonucleotide
cgggactctagctagagtcccgt

SEQ ID NO: 6176 - DNA, 23 bp, Artificial Sequence
  Description of Artificial Sequence: Synthetic oligonucleotide
agggactctagctagagtccctg

SEQ ID NO: 6177 - DNA, 23 bp, Artificial Sequence
  Description of Artificial Sequence: Synthetic oligonucleotide
caggactctagctagagtcctgg

SEQ ID NO: 6178 - DNA, 23 bp, Artificial Sequence
  Description of Artificial Sequence: Synthetic oligonucleotide
cgagactctagctagagtctcgg

SEQ ID NO: 6179 - DNA, 23 bp, Artificial Sequence
  Description of Artificial Sequence: Synthetic oligonucleotide
cgggactctagctagagtcccga

SEQ ID NO: 6180 - DNA, 23 bp, Artificial Sequence
  Description of Artificial Sequence: Synthetic oligonucleotide
tgggactctagctagagtcccag

SEQ ID NO: 6181 - DNA, 23 bp, Artificial Sequence
  Description of Artificial Sequence: Synthetic oligonucleotide
ctggactctagctagagtccagg

SEQ ID NO: 6182 - DNA, 23 bp, Artificial Sequence
  Description of Artificial Sequence: Synthetic oligonucleotide
cgtgactctagctagagtcacgg

SEQ ID NO: 6183 - DNA, 23 bp, Artificial Sequence
  Description of Artificial Sequence: Synthetic oligonucleotide
ggcgactctagctagagtcgccg

SEQ ID NO: 6184 - DNA, 23 bp, Artificial Sequence
  Description of Artificial Sequence: Synthetic oligonucleotide
agcgactctagctagagtcgctg

SEQ ID NO: 6185 - DNA, 23 bp, Artificial Sequence
  Description of Artificial Sequence: Synthetic oligonucleotide
gacgactctagctagagtcgtcg

SEQ ID NO: 6186 - DNA, 23 bp, Artificial Sequence
  Description of Artificial Sequence: Synthetic oligonucleotide
ggagactctagctagagtctccg

SEQ ID NO: 6187 - DNA, 23 bp, Artificial Sequence
  Description of Artificial Sequence: Synthetic oligonucleotide
tgcgactctagctagagtcgcag

SEQ ID NO: 6188 - DNA, 23 bp, Artificial Sequence
  Description of Artificial Sequence: Synthetic oligonucleotide
ggtgactctagctagagtcaccg

SEQ ID NO: 6189 - DNA, 23 bp, Artificial Sequence
  Description of Artificial Sequence: Synthetic oligonucleotide
acggactctagctagagtccgtg

SEQ ID NO: 6190 - DNA, 23 bp, Artificial Sequence
  Description of Artificial Sequence: Synthetic oligonucleotide
ccagactctagctagagtctggg

SEQ ID NO: 6191 - DNA, 23 bp, Artificial Sequence
  Description of Artificial Sequence: Synthetic oligonucleotide
tcggactctagctagagtccgag

SEQ ID NO: 6192 - DNA, 23 bp, Artificial Sequence
  Description of Artificial Sequence: Synthetic oligonucleotide
cctgactctagctagagtcaggg

SEQ ID NO: 6193 - DNA, 23 bp, Artificial Sequence
  Description of Artificial Sequence: Synthetic oligonucleotide
cacgactctagctagagtcgtgg

SEQ ID NO: 6194 - DNA, 23 bp, Artificial Sequence
  Description of Artificial Sequence: Synthetic oligonucleotide
gccgactctagctagagtcggct

SEQ ID NO: 6195 - DNA, 23 bp, Artificial Sequence
  Description of Artificial Sequence: Synthetic oligonucleotide
gccgactctagctagagtcggca

SEQ ID NO: 6196 - DNA, 23 bp, Artificial Sequence
  Description of Artificial Sequence: Synthetic oligonucleotide
cgagactctagctagagtctcgc

SEQ ID NO: 6197 - DNA, 23 bp, Artificial Sequence
  Description of Artificial Sequence: Synthetic oligonucleotide
cgtgactctagctagagtcacgc

SEQ ID NO: 6198 - DNA, 23 bp, Artificial Sequence
  Description of Artificial Sequence: Synthetic oligonucleotide
caggactctagctagagtcctgc

SEQ ID NO: 6199 - DNA, 23 bp, Artificial Sequence
  Description of Artificial Sequence: Synthetic oligonucleotide
ctggactctagctagagtccagc

SEQ ID NO: 6200 - DNA, 23 bp, Artificial Sequence
  Description of Artificial Sequence: Synthetic oligonucleotide
gaggactctagctagagtcctcg

SEQ ID NO: 6201 - DNA, 23 bp, Artificial Sequence
  Description of Artificial Sequence: Synthetic oligonucleotide
gtggactctagctagagtccacg

SEQ ID NO: 6202 - DNA, 23 bp, Artificial Sequence
  Description of Artificial Sequence: Synthetic oligonucleotide
accgactctagctagagtcggtg

SEQ ID NO: 6203 - DNA, 23 bp, Artificial Sequence
  Description of Artificial Sequence: Synthetic oligonucleotide
tccgactctagctagagtcggag

SEQ ID NO: 6204 - DNA, 23 bp, Artificial Sequence
  Description of Artificial Sequence: Synthetic oligonucleotide
cgggactctagctagagtcccgc

SEQ ID NO: 6205 - DNA, 23 bp, Artificial Sequence
  Description of Artificial Sequence: Synthetic oligonucleotide
agggactctagctagagtccctc

SEQ ID NO: 6206 - DNA, 23 bp, Artificial Sequence
  Description of Artificial Sequence: Synthetic oligonucleotide
tgggactctagctagagtcccac

SEQ ID NO: 6207 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctacgtagagtcnnnn

SEQ ID NO: 6208 - DNA, 23 bp, Artificial Sequence
  Description of Artificial Sequence: Synthetic oligonucleotide
gcggactctacgtagagtccgcc

SEQ ID NO: 6209 - DNA, 23 bp, Artificial Sequence
  Description of Artificial Sequence: Synthetic oligonucleotide
gcggactctacgtagagtccgct

SEQ ID NO: 6210 - DNA, 23 bp, Artificial Sequence
  Description of Artificial Sequence: Synthetic oligonucleotide
acggactctacgtagagtccgtc

SEQ ID NO: 6211 - DNA, 23 bp, Artificial Sequence
  Description of Artificial Sequence: Synthetic oligonucleotide
gaggactctacgtagagtcctcc

SEQ ID NO: 6212 - DNA, 23 bp, Artificial Sequence
  Description of Artificial Sequence: Synthetic oligonucleotide
gcagactctacgtagagtctgcc

SEQ ID NO: 6213 - DNA, 23 bp, Artificial Sequence
  Description of Artificial Sequence: Synthetic oligonucleotide
gcggactctacgtagagtccgca

SEQ ID NO: 6214 - DNA, 23 bp, Artificial Sequence
  Description of Artificial Sequence: Synthetic oligonucleotide
tcggactctacgtagagtccgac

SEQ ID NO: 6215 - DNA, 23 bp, Artificial Sequence
  Description of Artificial Sequence: Synthetic oligonucleotide
gtggactctacgtagagtccacc

SEQ ID NO: 6216 - DNA, 23 bp, Artificial Sequence
  Description of Artificial Sequence: Synthetic oligonucleotide
gctgactctacgtagagtcagcc

SEQ ID NO: 6217 - DNA, 23 bp, Artificial Sequence
  Description of Artificial Sequence: Synthetic oligonucleotide
cccgactctacgtagagtcgggc

SEQ ID NO: 6218 - DNA, 23 bp, Artificial Sequence
  Description of Artificial Sequence: Synthetic oligonucleotide
cccgactctacgtagagtcgggt

SEQ ID NO: 6219 - DNA, 23 bp, Artificial Sequence
  Description of Artificial Sequence: Synthetic oligonucleotide
accgactctacgtagagtcggtc

SEQ ID NO: 6220 - DNA, 23 bp, Artificial Sequence
  Description of Artificial Sequence: Synthetic oligonucleotide
cacgactctacgtagagtcgtgc

SEQ ID NO: 6221 - DNA, 23 bp, Artificial Sequence
  Description of Artificial Sequence: Synthetic oligonucleotide
ccagactctacgtagagtctggc

SEQ ID NO: 6222 - DNA, 23 bp, Artificial Sequence
  Description of Artificial Sequence: Synthetic oligonucleotide
cccgactctacgtagagtcggga

SEQ ID NO: 6223 - DNA, 23 bp, Artificial Sequence
  Description of Artificial Sequence: Synthetic oligonucleotide
tccgactctacgtagagtcggac

SEQ ID NO: 6224 - DNA, 23 bp, Artificial Sequence
  Description of Artificial Sequence: Synthetic oligonucleotide
cctgactctacgtagagtcaggc

SEQ ID NO: 6225 - DNA, 23 bp, Artificial Sequence
  Description of Artificial Sequence: Synthetic oligonucleotide
ggcgactctacgtagagtcgccc

SEQ ID NO: 6226 - DNA, 23 bp, Artificial Sequence
  Description of Artificial Sequence: Synthetic oligonucleotide
ggcgactctacgtagagtcgcct

SEQ ID NO: 6227 - DNA, 23 bp, Artificial Sequence
  Description of Artificial Sequence: Synthetic oligonucleotide
agcgactctacgtagagtcgctc

SEQ ID NO: 6228 - DNA, 23 bp, Artificial Sequence
  Description of Artificial Sequence: Synthetic oligonucleotide
gacgactctacgtagagtcgtcc

SEQ ID NO: 6229 - DNA, 23 bp, Artificial Sequence
  Description of Artificial Sequence: Synthetic oligonucleotide
ggagactctacgtagagtctccc

SEQ ID NO: 6230 - DNA, 23 bp, Artificial Sequence
  Description of Artificial Sequence: Synthetic oligonucleotide
ggcgactctacgtagagtcgcca

SEQ ID NO: 6231 - DNA, 23 bp, Artificial Sequence
  Description of Artificial Sequence: Synthetic oligonucleotide
tgcgactctacgtagagtcgcac

SEQ ID NO: 6232 - DNA, 23 bp, Artificial Sequence
  Description of Artificial Sequence: Synthetic oligonucleotide
ggtgactctacgtagagtcaccc

SEQ ID NO: 6233 - DNA, 23 bp, Artificial Sequence
  Description of Artificial Sequence: Synthetic oligonucleotide
cgggactctacgtagagtcccgt

SEQ ID NO: 6234 - DNA, 23 bp, Artificial Sequence
  Description of Artificial Sequence: Synthetic oligonucleotide
agggactctacgtagagtccctg

SEQ ID NO: 6235 - DNA, 23 bp, Artificial Sequence
  Description of Artificial Sequence: Synthetic oligonucleotide
caggactctacgtagagtcctgg

SEQ ID NO: 6236 - DNA, 23 bp, Artificial Sequence
  Description of Artificial Sequence: Synthetic oligonucleotide
cgagactctacgtagagtctcgg

SEQ ID NO: 6237 - DNA, 23 bp, Artificial Sequence
  Description of Artificial Sequence: Synthetic oligonucleotide
cgggactctacgtagagtcccga

SEQ ID NO: 6238 - DNA, 23 bp, Artificial Sequence
  Description of Artificial Sequence: Synthetic oligonucleotide
tgggactctacgtagagtcccag

SEQ ID NO: 6239 - DNA, 23 bp, Artificial Sequence
  Description of Artificial Sequence: Synthetic oligonucleotide
ctggactctacgtagagtccagg

SEQ ID NO: 6240 - DNA, 23 bp, Artificial Sequence
  Description of Artificial Sequence: Synthetic oligonucleotide
cgtgactctacgtagagtcacgg

SEQ ID NO: 6241 - DNA, 23 bp, Artificial Sequence
  Description of Artificial Sequence: Synthetic oligonucleotide
ggcgactctacgtagagtcgccg

SEQ ID NO: 6242 - DNA, 23 bp, Artificial Sequence
  Description of Artificial Sequence: Synthetic oligonucleotide
agcgactctacgtagagtcgctg

SEQ ID NO: 6243 - DNA, 23 bp, Artificial Sequence
  Description of Artificial Sequence: Synthetic oligonucleotide
gacgactctacgtagagtcgtcg

SEQ ID NO: 6244 - DNA, 23 bp, Artificial Sequence
  Description of Artificial Sequence: Synthetic oligonucleotide
ggagactctacgtagagtctccg

SEQ ID NO: 6245 - DNA, 23 bp, Artificial Sequence
  Description of Artificial Sequence: Synthetic oligonucleotide
tgcgactctacgtagagtcgcag

SEQ ID NO: 6246 - DNA, 23 bp, Artificial Sequence
  Description of Artificial Sequence: Synthetic oligonucleotide
ggtgactctacgtagagtcaccg

SEQ ID NO: 6247 - DNA, 23 bp, Artificial Sequence
  Description of Artificial Sequence: Synthetic oligonucleotide
acggactctacgtagagtccgtg

SEQ ID NO: 6248 - DNA, 23 bp, Artificial Sequence
  Description of Artificial Sequence: Synthetic oligonucleotide
ccagactctacgtagagtctggg

SEQ ID NO: 6249 - DNA, 23 bp, Artificial Sequence
  Description of Artificial Sequence: Synthetic oligonucleotide
tcggactctacgtagagtccgag

SEQ ID NO: 6250 - DNA, 23 bp, Artificial Sequence
  Description of Artificial Sequence: Synthetic oligonucleotide
cctgactctacgtagagtcaggg

SEQ ID NO: 6251 - DNA, 23 bp, Artificial Sequence
  Description of Artificial Sequence: Synthetic oligonucleotide
cacgactctacgtagagtcgtgg

SEQ ID NO: 6252 - DNA, 23 bp, Artificial Sequence
  Description of Artificial Sequence: Synthetic oligonucleotide
gccgactctacgtagagtcggct

SEQ ID NO: 6253 - DNA, 23 bp, Artificial Sequence
  Description of Artificial Sequence: Synthetic oligonucleotide
gccgactctacgtagagtcggca

SEQ ID NO: 6254 - DNA, 23 bp, Artificial Sequence
  Description of Artificial Sequence: Synthetic oligonucleotide
cgagactctacgtagagtctcgc

SEQ ID NO: 6255 - DNA, 23 bp, Artificial Sequence
  Description of Artificial Sequence: Synthetic oligonucleotide
cgtgactctacgtagagtcacgc

SEQ ID NO: 6256 - DNA, 23 bp, Artificial Sequence
  Description of Artificial Sequence: Synthetic oligonucleotide
caggactctacgtagagtcctgc

SEQ ID NO: 6257 - DNA, 23 bp, Artificial Sequence
  Description of Artificial Sequence: Synthetic oligonucleotide
ctggactctacgtagagtccagc

SEQ ID NO: 6258 - DNA, 23 bp, Artificial Sequence
  Description of Artificial Sequence: Synthetic oligonucleotide
gaggactctacgtagagtcctcg

SEQ ID NO: 6259 - DNA, 23 bp, Artificial Sequence
  Description of Artificial Sequence: Synthetic oligonucleotide
gtggactctacgtagagtccacg

SEQ ID NO: 6260 - DNA, 23 bp, Artificial Sequence
  Description of Artificial Sequence: Synthetic oligonucleotide
accgactctacgtagagtcggtg

SEQ ID NO: 6261 - DNA, 23 bp, Artificial Sequence
  Description of Artificial Sequence: Synthetic oligonucleotide
tccgactctacgtagagtcggag

SEQ ID NO: 6262 - DNA, 23 bp, Artificial Sequence
  Description of Artificial Sequence: Synthetic oligonucleotide
cgggactctacgtagagtcccgc

SEQ ID NO: 6263 - DNA, 23 bp, Artificial Sequence
  Description of Artificial Sequence: Synthetic oligonucleotide
agggactctacgtagagtccctc

SEQ ID NO: 6264 - DNA, 23 bp, Artificial Sequence
  Description of Artificial Sequence: Synthetic oligonucleotide
tgggactctacgtagagtcccac

SEQ ID NO: 6265 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcatatatgagtcnnnn

SEQ ID NO: 6266 - DNA, 23 bp, Artificial Sequence
  Description of Artificial Sequence: Synthetic oligonucleotide
gcggactcatatatgagtccgcc

SEQ ID NO: 6267 - DNA, 23 bp, Artificial Sequence
  Description of Artificial Sequence: Synthetic oligonucleotide
gcggactcatatatgagtccgct

SEQ ID NO: 6268 - DNA, 23 bp, Artificial Sequence
  Description of Artificial Sequence: Synthetic oligonucleotide
acggactcatatatgagtccgtc

SEQ ID NO: 6269 - DNA, 23 bp, Artificial Sequence
  Description of Artificial Sequence: Synthetic oligonucleotide
gaggactcatatatgagtcctcc

SEQ ID NO: 6270 - DNA, 23 bp, Artificial Sequence
  Description of Artificial Sequence: Synthetic oligonucleotide
gcagactcatatatgagtctgcc

SEQ ID NO: 6271 - DNA, 23 bp, Artificial Sequence
  Description of Artificial Sequence: Synthetic oligonucleotide
gcggactcatatatgagtccgca

SEQ ID NO: 6272 - DNA, 23 bp, Artificial Sequence
  Description of Artificial Sequence: Synthetic oligonucleotide
tcggactcatatatgagtccgac

SEQ ID NO: 6273 - DNA, 23 bp, Artificial Sequence
  Description of Artificial Sequence: Synthetic oligonucleotide
gtggactcatatatgagtccacc

SEQ ID NO: 6274 - DNA, 23 bp, Artificial Sequence
  Description of Artificial Sequence: Synthetic oligonucleotide
gctgactcatatatgagtcagcc

SEQ ID NO: 6275 - DNA, 23 bp, Artificial Sequence
  Description of Artificial Sequence: Synthetic oligonucleotide
cccgactcatatatgagtcgggc

SEQ ID NO: 6276 - DNA, 23 bp, Artificial Sequence
  Description of Artificial Sequence: Synthetic oligonucleotide
cccgactcatatatgagtcgggt

SEQ ID NO: 6277 - DNA, 23 bp, Artificial Sequence
  Description of Artificial Sequence: Synthetic oligonucleotide
accgactcatatatgagtcggtc

SEQ ID NO: 6278 - DNA, 23 bp, Artificial Sequence
  Description of Artificial Sequence: Synthetic oligonucleotide
cacgactcatatatgagtcgtgc

SEQ ID NO: 6279 - DNA, 23 bp, Artificial Sequence
  Description of Artificial Sequence: Synthetic oligonucleotide
ccagactcatatatgagtctggc

SEQ ID NO: 6280 - DNA, 23 bp, Artificial Sequence
  Description of Artificial Sequence: Synthetic oligonucleotide
cccgactcatatatgagtcggga

SEQ ID NO: 6281 - DNA, 23 bp, Artificial Sequence
  Description of Artificial Sequence: Synthetic oligonucleotide
tccgactcatatatgagtcggac

SEQ ID NO: 6282 - DNA, 23 bp, Artificial Sequence
  Description of Artificial Sequence: Synthetic oligonucleotide
cctgactcatatatgagtcaggc

SEQ ID NO: 6283 - DNA, 23 bp, Artificial Sequence
  Description of Artificial Sequence: Synthetic oligonucleotide
ggcgactcatatatgagtcgccc

SEQ ID NO: 6284 - DNA, 23 bp, Artificial Sequence
  Description of Artificial Sequence: Synthetic oligonucleotide
ggcgactcatatatgagtcgcct

SEQ ID NO: 6285 - DNA, 23 bp, Artificial Sequence
  Description of Artificial Sequence: Synthetic oligonucleotide
agcgactcatatatgagtcgctc

SEQ ID NO: 6286 - DNA, 23 bp, Artificial Sequence
  Description of Artificial Sequence: Synthetic oligonucleotide
gacgactcatatatgagtcgtcc

SEQ ID NO: 6287 - DNA, 23 bp, Artificial Sequence
  Description of Artificial Sequence: Synthetic oligonucleotide
ggagactcatatatgagtctccc

SEQ ID NO: 6288 - DNA, 23 bp, Artificial Sequence
  Description of Artificial Sequence: Synthetic oligonucleotide
ggcgactcatatatgagtcgcca

SEQ ID NO: 6289 - DNA, 23 bp, Artificial Sequence
  Description of Artificial Sequence: Synthetic oligonucleotide
tgcgactcatatatgagtcgcac

SEQ ID NO: 6290 - DNA, 23 bp, Artificial Sequence
  Description of Artificial Sequence: Synthetic oligonucleotide
ggtgactcatatatgagtcaccc

SEQ ID NO: 6291 - DNA, 23 bp, Artificial Sequence
  Description of Artificial Sequence: Synthetic oligonucleotide
cgggactcatatatgagtcccgt

SEQ ID NO: 6292 - DNA, 23 bp, Artificial Sequence
  Description of Artificial Sequence: Synthetic oligonucleotide
agggactcatatatgagtccctg

SEQ ID NO: 6293 - DNA, 23 bp, Artificial Sequence
  Description of Artificial Sequence: Synthetic oligonucleotide
caggactcatatatgagtcctgg

SEQ ID NO: 6294 - DNA, 23 bp, Artificial Sequence
  Description of Artificial Sequence: Synthetic oligonucleotide
cgagactcatatatgagtctcgg

SEQ ID NO: 6295 - DNA, 23 bp, Artificial Sequence
  Description of Artificial Sequence: Synthetic oligonucleotide
cgggactcatatatgagtcccga

SEQ ID NO: 6296 - DNA, 23 bp, Artificial Sequence
  Description of Artificial Sequence: Synthetic oligonucleotide
tgggactcatatatgagtcccag

SEQ ID NO: 6297 - DNA, 23 bp, Artificial Sequence
  Description of Artificial Sequence: Synthetic oligonucleotide
ctggactcatatatgagtccagg

SEQ ID NO: 6298 - DNA, 23 bp, Artificial Sequence
  Description of Artificial Sequence: Synthetic oligonucleotide
cgtgactcatatatgagtcacgg

SEQ ID NO: 6299 - DNA, 23 bp, Artificial Sequence
  Description of Artificial Sequence: Synthetic oligonucleotide
ggcgactcatatatgagtcgccg

SEQ ID NO: 6300 - DNA, 23 bp, Artificial Sequence
  Description of Artificial Sequence: Synthetic oligonucleotide
agcgactcatatatgagtcgctg

SEQ ID NO: 6301 - DNA, 23 bp, Artificial Sequence
  Description of Artificial Sequence: Synthetic oligonucleotide
gacgactcatatatgagtcgtcg

SEQ ID NO: 6302 - DNA, 23 bp, Artificial Sequence
  Description of Artificial Sequence: Synthetic oligonucleotide
ggagactcatatatgagtctccg

SEQ ID NO: 6303 - DNA, 23 bp, Artificial Sequence
  Description of Artificial Sequence: Synthetic oligonucleotide
tgcgactcatatatgagtcgcag

SEQ ID NO: 6304 - DNA, 23 bp, Artificial Sequence
  Description of Artificial Sequence: Synthetic oligonucleotide
ggtgactcatatatgagtcaccg

SEQ ID NO: 6305 - DNA, 23 bp, Artificial Sequence
  Description of Artificial Sequence: Synthetic oligonucleotide
acggactcatatatgagtccgtg

SEQ ID NO: 6306 - DNA, 23 bp, Artificial Sequence
  Description of Artificial Sequence: Synthetic oligonucleotide
ccagactcatatatgagtctggg

SEQ ID NO: 6307 - DNA, 23 bp, Artificial Sequence
  Description of Artificial Sequence: Synthetic oligonucleotide
tcggactcatatatgagtccgag

SEQ ID NO: 6308 - DNA, 23 bp, Artificial Sequence
  Description of Artificial Sequence: Synthetic oligonucleotide
cctgactcatatatgagtcaggg

SEQ ID NO: 6309 - DNA, 23 bp, Artificial Sequence
  Description of Artificial Sequence: Synthetic oligonucleotide
cacgactcatatatgagtcgtgg

SEQ ID NO: 6310 - DNA, 23 bp, Artificial Sequence
  Description of Artificial Sequence: Synthetic oligonucleotide
gccgactcatatatgagtcggct

SEQ ID NO: 6311 - DNA, 23 bp, Artificial Sequence
  Description of Artificial Sequence: Synthetic oligonucleotide
gccgactcatatatgagtcggca

SEQ ID NO: 6312 - DNA, 23 bp, Artificial Sequence
  Description of Artificial Sequence: Synthetic oligonucleotide
cgagactcatatatgagtctcgc

SEQ ID NO: 6313 - DNA, 23 bp, Artificial Sequence
  Description of Artificial Sequence: Synthetic oligonucleotide
cgtgactcatatatgagtcacgc

SEQ ID NO: 6314 - DNA, 23 bp, Artificial Sequence
  Description of Artificial Sequence: Synthetic oligonucleotide
caggactcatatatgagtcctgc

SEQ ID NO: 6315 - DNA, 23 bp, Artificial Sequence
  Description of Artificial Sequence: Synthetic oligonucleotide
ctggactcatatatgagtccagc

SEQ ID NO: 6316 - DNA, 23 bp, Artificial Sequence
  Description of Artificial Sequence: Synthetic oligonucleotide
gaggactcatatatgagtcctcg

SEQ ID NO: 6317 - DNA, 23 bp, Artificial Sequence
  Description of Artificial Sequence: Synthetic oligonucleotide
gtggactcatatatgagtccacg

SEQ ID NO: 6318 - DNA, 23 bp, Artificial Sequence
  Description of Artificial Sequence: Synthetic oligonucleotide
accgactcatatatgagtcggtg

SEQ ID NO: 6319 - DNA, 23 bp, Artificial Sequence
  Description of Artificial Sequence: Synthetic oligonucleotide
tccgactcatatatgagtcggag

SEQ ID NO: 6320 - DNA, 23 bp, Artificial Sequence
  Description of Artificial Sequence: Synthetic oligonucleotide
cgggactcatatatgagtcccgc

SEQ ID NO: 6321 - DNA, 23 bp, Artificial Sequence
  Description of Artificial Sequence: Synthetic oligonucleotide
agggactcatatatgagtccctc

SEQ ID NO: 6322 - DNA, 23 bp, Artificial Sequence
  Description of Artificial Sequence: Synthetic oligonucleotide
tgggactcatatatgagtcccac

SEQ ID NO: 6323 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcattaatgagtcnnnn

SEQ ID NO: 6324 - DNA, 23 bp, Artificial Sequence
  Description of Artificial Sequence: Synthetic oligonucleotide
gcggactcattaatgagtccgcc

SEQ ID NO: 6325 - DNA, 23 bp, Artificial Sequence
  Description of Artificial Sequence: Synthetic oligonucleotide
gcggactcattaatgagtccgct

SEQ ID NO: 6326 - DNA, 23 bp, Artificial Sequence
  Description of Artificial Sequence: Synthetic oligonucleotide
acggactcattaatgagtccgtc

SEQ ID NO: 6327 - DNA, 23 bp, Artificial Sequence
  Description of Artificial Sequence: Synthetic oligonucleotide
gaggactcattaatgagtcctcc

SEQ ID NO: 6328 - DNA, 23 bp, Artificial Sequence
  Description of Artificial Sequence: Synthetic oligonucleotide
gcagactcattaatgagtctgcc

SEQ ID NO: 6329 - DNA, 23 bp, Artificial Sequence
  Description of Artificial Sequence: Synthetic oligonucleotide
gcggactcattaatgagtccgca

SEQ ID NO: 6330 - DNA, 23 bp, Artificial Sequence
  Description of Artificial Sequence: Synthetic oligonucleotide
tcggactcattaatgagtccgac

SEQ ID NO: 6331 - DNA, 23 bp, Artificial Sequence
  Description of Artificial Sequence: Synthetic oligonucleotide
gtggactcattaatgagtccacc

SEQ ID NO: 6332 - DNA, 23 bp, Artificial Sequence
  Description of Artificial Sequence: Synthetic oligonucleotide
gctgactcattaatgagtcagcc

SEQ ID NO: 6333 - DNA, 23 bp, Artificial Sequence
  Description of Artificial Sequence: Synthetic oligonucleotide
cccgactcattaatgagtcgggc

SEQ ID NO: 6334 - DNA, 23 bp, Artificial Sequence
  Description of Artificial Sequence: Synthetic oligonucleotide
cccgactcattaatgagtcgggt

SEQ ID NO: 6335 - DNA, 23 bp, Artificial Sequence
  Description of Artificial Sequence: Synthetic oligonucleotide
accgactcattaatgagtcggtc

SEQ ID NO: 6336 - DNA, 23 bp, Artificial Sequence
  Description of Artificial Sequence: Synthetic oligonucleotide
cacgactcattaatgagtcgtgc

SEQ ID NO: 6337 - DNA, 23 bp, Artificial Sequence
  Description of Artificial Sequence: Synthetic oligonucleotide
ccagactcattaatgagtctggc

SEQ ID NO: 6338 - DNA, 23 bp, Artificial Sequence
  Description of Artificial Sequence: Synthetic oligonucleotide
cccgactcattaatgagtcggga

SEQ ID NO: 6339 - DNA, 23 bp, Artificial Sequence
  Description of Artificial Sequence: Synthetic oligonucleotide
tccgactcattaatgagtcggac

SEQ ID NO: 6340 - DNA, 23 bp, Artificial Sequence
  Description of Artificial Sequence: Synthetic oligonucleotide
cctgactcattaatgagtcaggc

SEQ ID NO: 6341 - DNA, 23 bp, Artificial Sequence
  Description of Artificial Sequence: Synthetic oligonucleotide
ggcgactcattaatgagtcgccc

SEQ ID NO: 6342 - DNA, 23 bp, Artificial Sequence
  Description of Artificial Sequence: Synthetic oligonucleotide
ggcgactcattaatgagtcgcct

SEQ ID NO: 6343 - DNA, 23 bp, Artificial Sequence
  Description of Artificial Sequence: Synthetic oligonucleotide
agcgactcattaatgagtcgctc

SEQ ID NO: 6344 - DNA, 23 bp, Artificial Sequence
  Description of Artificial Sequence: Synthetic oligonucleotide
gacgactcattaatgagtcgtcc

SEQ ID NO: 6345 - DNA, 23 bp, Artificial Sequence
  Description of Artificial Sequence: Synthetic oligonucleotide
ggagactcattaatgagtctccc

SEQ ID NO: 6346 - DNA, 23 bp, Artificial Sequence
  Description of Artificial Sequence: Synthetic oligonucleotide
ggcgactcattaatgagtcgcca

SEQ ID NO: 6347 - DNA, 23 bp, Artificial Sequence
  Description of Artificial Sequence: Synthetic oligonucleotide
tgcgactcattaatgagtcgcac

SEQ ID NO: 6348 - DNA, 23 bp, Artificial Sequence
  Description of Artificial Sequence: Synthetic oligonucleotide
ggtgactcattaatgagtcaccc

SEQ ID NO: 6349 - DNA, 23 bp, Artificial Sequence
  Description of Artificial Sequence: Synthetic oligonucleotide
cgggactcattaatgagtcccgt

SEQ ID NO: 6350 - DNA, 23 bp, Artificial Sequence
  Description of Artificial Sequence: Synthetic oligonucleotide
agggactcattaatgagtccctg

SEQ ID NO: 6351 - DNA, 23 bp, Artificial Sequence
  Description of Artificial Sequence: Synthetic oligonucleotide
caggactcattaatgagtcctgg

SEQ ID NO: 6352 - DNA, 23 bp, Artificial Sequence
  Description of Artificial Sequence: Synthetic oligonucleotide
cgagactcattaatgagtctcgg

SEQ ID NO: 6353 - DNA, 23 bp, Artificial Sequence
  Description of Artificial Sequence: Synthetic oligonucleotide
cgggactcattaatgagtcccga

SEQ ID NO: 6354 - DNA, 23 bp, Artificial Sequence
  Description of Artificial Sequence: Synthetic oligonucleotide
tgggactcattaatgagtcccag

SEQ ID NO: 6355 - DNA, 23 bp, Artificial Sequence
  Description of Artificial Sequence: Synthetic oligonucleotide
ctggactcattaatgagtccagg

SEQ ID NO: 6356 - DNA, 23 bp, Artificial Sequence
  Description of Artificial Sequence: Synthetic oligonucleotide
cgtgactcattaatgagtcacgg

SEQ ID NO: 6357 - DNA, 23 bp, Artificial Sequence
  Description of Artificial Sequence: Synthetic oligonucleotide
ggcgactcattaatgagtcgccg

SEQ ID NO: 6358 - DNA, 23 bp, Artificial Sequence
  Description of Artificial Sequence: Synthetic oligonucleotide
agcgactcattaatgagtcgctg

SEQ ID NO: 6359 - DNA, 23 bp, Artificial Sequence
  Description of Artificial Sequence: Synthetic oligonucleotide
gacgactcattaatgagtcgtcg

SEQ ID NO: 6360 - DNA, 23 bp, Artificial Sequence
  Description of Artificial Sequence: Synthetic oligonucleotide
ggagactcattaatgagtctccg

SEQ ID NO: 6361 - DNA, 23 bp, Artificial Sequence
  Description of Artificial Sequence: Synthetic oligonucleotide
tgcgactcattaatgagtcgcag

SEQ ID NO: 6362 - DNA, 23 bp, Artificial Sequence
  Description of Artificial Sequence: Synthetic oligonucleotide
ggtgactcattaatgagtcaccg

SEQ ID NO: 6363 - DNA, 23 bp, Artificial Sequence
  Description of Artificial Sequence: Synthetic oligonucleotide
acggactcattaatgagtccgtg

SEQ ID NO: 6364 - DNA, 23 bp, Artificial Sequence
  Description of Artificial Sequence: Synthetic oligonucleotide
ccagactcattaatgagtctggg

SEQ ID NO: 6365 - DNA, 23 bp, Artificial Sequence
  Description of Artificial Sequence: Synthetic oligonucleotide
tcggactcattaatgagtccgag

SEQ ID NO: 6366 - DNA, 23 bp, Artificial Sequence
  Description of Artificial Sequence: Synthetic oligonucleotide
cctgactcattaatgagtcaggg

SEQ ID NO: 6367 - DNA, 23 bp, Artificial Sequence
  Description of Artificial Sequence: Synthetic oligonucleotide
cacgactcattaatgagtcgtgg

SEQ ID NO: 6368 - DNA, 23 bp, Artificial Sequence
  Description of Artificial Sequence: Synthetic oligonucleotide
gccgactcattaatgagtcggct

SEQ ID NO: 6369 - DNA, 23 bp, Artificial Sequence
  Description of Artificial Sequence: Synthetic oligonucleotide
gccgactcattaatgagtcggca

SEQ ID NO: 6370 - DNA, 23 bp, Artificial Sequence
  Description of Artificial Sequence: Synthetic oligonucleotide
cgagactcattaatgagtctcgc

SEQ ID NO: 6371 - DNA, 23 bp, Artificial Sequence
  Description of Artificial Sequence: Synthetic oligonucleotide
cgtgactcattaatgagtcacgc

SEQ ID NO: 6372 - DNA, 23 bp, Artificial Sequence
  Description of Artificial Sequence: Synthetic oligonucleotide
caggactcattaatgagtcctgc

SEQ ID NO: 6373 - DNA, 23 bp, Artificial Sequence
  Description of Artificial Sequence: Synthetic oligonucleotide
ctggactcattaatgagtccagc

SEQ ID NO: 6374 - DNA, 23 bp, Artificial Sequence
  Description of Artificial Sequence: Synthetic oligonucleotide
gaggactcattaatgagtcctcg

SEQ ID NO: 6375 - DNA, 23 bp, Artificial Sequence
  Description of Artificial Sequence: Synthetic oligonucleotide
gtggactcattaatgagtccacg

SEQ ID NO: 6376 - DNA, 23 bp, Artificial Sequence
  Description of Artificial Sequence: Synthetic oligonucleotide
accgactcattaatgagtcggtg

SEQ ID NO: 6377 - DNA, 23 bp, Artificial Sequence
  Description of Artificial Sequence: Synthetic oligonucleotide
tccgactcattaatgagtcggag

SEQ ID NO: 6378 - DNA, 23 bp, Artificial Sequence
  Description of Artificial Sequence: Synthetic oligonucleotide
cgggactcattaatgagtcccgc

SEQ ID NO: 6379 - DNA, 23 bp, Artificial Sequence
  Description of Artificial Sequence: Synthetic oligonucleotide
agggactcattaatgagtccctc

SEQ ID NO: 6380 - DNA, 23 bp, Artificial Sequence
  Description of Artificial Sequence: Synthetic oligonucleotide
tgggactcattaatgagtcccac

SEQ ID NO: 6381 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcatgcatgagtcnnnn

SEQ ID NO: 6382 - DNA, 23 bp, Artificial Sequence
  Description of Artificial Sequence: Synthetic oligonucleotide
gcggactcatgcatgagtccgcc

SEQ ID NO: 6383 - DNA, 23 bp, Artificial Sequence
  Description of Artificial Sequence: Synthetic oligonucleotide
gcggactcatgcatgagtccgct

SEQ ID NO: 6384 - DNA, 23 bp, Artificial Sequence
  Description of Artificial Sequence: Synthetic oligonucleotide
acggactcatgcatgagtccgtc

SEQ ID NO: 6385 - DNA, 23 bp, Artificial Sequence
  Description of Artificial Sequence: Synthetic oligonucleotide
gaggactcatgcatgagtcctcc

SEQ ID NO: 6386 - DNA, 23 bp, Artificial Sequence
  Description of Artificial Sequence: Synthetic oligonucleotide
gcagactcatgcatgagtctgcc

SEQ ID NO: 6387 - DNA, 23 bp, Artificial Sequence
  Description of Artificial Sequence: Synthetic oligonucleotide
gcggactcatgcatgagtccgca

SEQ ID NO: 6388 - DNA, 23 bp, Artificial Sequence
  Description of Artificial Sequence: Synthetic oligonucleotide
tcggactcatgcatgagtccgac

SEQ ID NO: 6389 - DNA, 23 bp, Artificial Sequence
  Description of Artificial Sequence: Synthetic oligonucleotide
gtggactcatgcatgagtccacc

SEQ ID NO: 6390 - DNA, 23 bp, Artificial Sequence
  Description of Artificial Sequence: Synthetic oligonucleotide
gctgactcatgcatgagtcagcc

SEQ ID NO: 6391 - DNA, 23 bp, Artificial Sequence
  Description of Artificial Sequence: Synthetic oligonucleotide
cccgactcatgcatgagtcgggc

SEQ ID NO: 6392 - DNA, 23 bp, Artificial Sequence
  Description of Artificial Sequence: Synthetic oligonucleotide
cccgactcatgcatgagtcgggt

SEQ ID NO: 6393 - DNA, 23 bp, Artificial Sequence
  Description of Artificial Sequence: Synthetic oligonucleotide
accgactcatgcatgagtcggtc

SEQ ID NO: 6394 - DNA, 23 bp, Artificial Sequence
  Description of Artificial Sequence: Synthetic oligonucleotide
cacgactcatgcatgagtcgtgc

SEQ ID NO: 6395 - DNA, 23 bp, Artificial Sequence
  Description of Artificial Sequence: Synthetic oligonucleotide
ccagactcatgcatgagtctggc

SEQ ID NO: 6396 - DNA, 23 bp, Artificial Sequence
  Description of Artificial Sequence: Synthetic oligonucleotide
cccgactcatgcatgagtcggga

SEQ ID NO: 6397 - DNA, 23 bp, Artificial Sequence
  Description of Artificial Sequence: Synthetic oligonucleotide
tccgactcatgcatgagtcggac

SEQ ID NO: 6398 - DNA, 23 bp, Artificial Sequence
  Description of Artificial Sequence: Synthetic oligonucleotide
cctgactcatgcatgagtcaggc

SEQ ID NO: 6399 - DNA, 23 bp, Artificial Sequence
  Description of Artificial Sequence: Synthetic oligonucleotide
ggcgactcatgcatgagtcgccc

SEQ ID NO: 6400 - DNA, 23 bp, Artificial Sequence
  Description of Artificial Sequence: Synthetic oligonucleotide
ggcgactcatgcatgagtcgcct

SEQ ID NO: 6401 - DNA, 23 bp, Artificial Sequence
  Description of Artificial Sequence: Synthetic oligonucleotide
agcgactcatgcatgagtcgctc

SEQ ID NO: 6402 - DNA, 23 bp, Artificial Sequence
  Description of Artificial Sequence: Synthetic oligonucleotide
gacgactcatgcatgagtcgtcc

SEQ ID NO: 6403 - DNA, 23 bp, Artificial Sequence
  Description of Artificial Sequence: Synthetic oligonucleotide
ggagactcatgcatgagtctccc

SEQ ID NO: 6404 - DNA, 23 bp, Artificial Sequence
  Description of Artificial Sequence: Synthetic oligonucleotide
ggcgactcatgcatgagtcgcca

SEQ ID NO: 6405 - DNA, 23 bp, Artificial Sequence
  Description of Artificial Sequence: Synthetic oligonucleotide
tgcgactcatgcatgagtcgcac

SEQ ID NO: 6406 - DNA, 23 bp, Artificial Sequence
  Description of Artificial Sequence: Synthetic oligonucleotide
ggtgactcatgcatgagtcaccc

SEQ ID NO: 6407 - DNA, 23 bp, Artificial Sequence
  Description of Artificial Sequence: Synthetic oligonucleotide
cgggactcatgcatgagtcccgt

SEQ ID NO: 6408 - DNA, 23 bp, Artificial Sequence
  Description of Artificial Sequence: Synthetic oligonucleotide
agggactcatgcatgagtccctg

SEQ ID NO: 6409 - DNA, 23 bp, Artificial Sequence
  Description of Artificial Sequence: Synthetic oligonucleotide
caggactcatgcatgagtcctgg

SEQ ID NO: 6410 - DNA, 23 bp, Artificial Sequence
  Description of Artificial Sequence: Synthetic oligonucleotide
cgagactcatgcatgagtctcgg

SEQ ID NO: 6411 - DNA, 23 bp, Artificial Sequence
  Description of Artificial Sequence: Synthetic oligonucleotide
cgggactcatgcatgagtcccga

SEQ ID NO: 6412 - DNA, 23 bp, Artificial Sequence
  Description of Artificial Sequence: Synthetic oligonucleotide
tgggactcatgcatgagtcccag

SEQ ID NO: 6413 - DNA, 23 bp, Artificial Sequence
  Description of Artificial Sequence: Synthetic oligonucleotide
ctggactcatgcatgagtccagg

SEQ ID NO: 6414 - DNA, 23 bp, Artificial Sequence
  Description of Artificial Sequence: Synthetic oligonucleotide
cgtgactcatgcatgagtcacgg

SEQ ID NO: 6415 - DNA, 23 bp, Artificial Sequence
  Description of Artificial Sequence: Synthetic oligonucleotide
ggcgactcatgcatgagtcgccg

SEQ ID NO: 6416 - DNA, 23 bp, Artificial Sequence
  Description of Artificial Sequence: Synthetic oligonucleotide
agcgactcatgcatgagtcgctg

SEQ ID NO: 6417 - DNA, 23 bp, Artificial Sequence
  Description of Artificial Sequence: Synthetic oligonucleotide
gacgactcatgcatgagtcgtcg

SEQ ID NO: 6418 - DNA, 23 bp, Artificial Sequence
  Description of Artificial Sequence: Synthetic oligonucleotide
ggagactcatgcatgagtctccg

SEQ ID NO: 6419 - DNA, 23 bp, Artificial Sequence
  Description of Artificial Sequence: Synthetic oligonucleotide
tgcgactcatgcatgagtcgcag

SEQ ID NO: 6420 - DNA, 23 bp, Artificial Sequence
  Description of Artificial Sequence: Synthetic oligonucleotide
ggtgactcatgcatgagtcaccg

SEQ ID NO: 6421 - DNA, 23 bp, Artificial Sequence
  Description of Artificial Sequence: Synthetic oligonucleotide
acggactcatgcatgagtccgtg

SEQ ID NO: 6422 - DNA, 23 bp, Artificial Sequence
  Description of Artificial Sequence: Synthetic oligonucleotide
ccagactcatgcatgagtctggg

SEQ ID NO: 6423 - DNA, 23 bp, Artificial Sequence
  Description of Artificial Sequence: Synthetic oligonucleotide
tcggactcatgcatgagtccgag

SEQ ID NO: 6424 - DNA, 23 bp, Artificial Sequence
  Description of Artificial Sequence: Synthetic oligonucleotide
cctgactcatgcatgagtcaggg

SEQ ID NO: 6425 - DNA, 23 bp, Artificial Sequence
  Description of Artificial Sequence: Synthetic oligonucleotide
cacgactcatgcatgagtcgtgg

SEQ ID NO: 6426 - DNA, 23 bp, Artificial Sequence
  Description of Artificial Sequence: Synthetic oligonucleotide
gccgactcatgcatgagtcggct

SEQ ID NO: 6427 - DNA, 23 bp, Artificial Sequence
  Description of Artificial Sequence: Synthetic oligonucleotide
gccgactcatgcatgagtcggca

SEQ ID NO: 6428 - DNA, 23 bp, Artificial Sequence
  Description of Artificial Sequence: Synthetic oligonucleotide
cgagactcatgcatgagtctcgc

SEQ ID NO: 6429 - DNA, 23 bp, Artificial Sequence
  Description of Artificial Sequence: Synthetic oligonucleotide
cgtgactcatgcatgagtcacgc

SEQ ID NO: 6430 - DNA, 23 bp, Artificial Sequence
  Description of Artificial Sequence: Synthetic oligonucleotide
caggactcatgcatgagtcctgc

SEQ ID NO: 6431 - DNA, 23 bp, Artificial Sequence
  Description of Artificial Sequence: Synthetic oligonucleotide
ctggactcatgcatgagtccagc

SEQ ID NO: 6432 - DNA, 23 bp, Artificial Sequence
  Description of Artificial Sequence: Synthetic oligonucleotide
gaggactcatgcatgagtcctcg

SEQ ID NO: 6433 - DNA, 23 bp, Artificial Sequence
  Description of Artificial Sequence: Synthetic oligonucleotide
gtggactcatgcatgagtccacg

SEQ ID NO: 6434 - DNA, 23 bp, Artificial Sequence
  Description of Artificial Sequence: Synthetic oligonucleotide
accgactcatgcatgagtcggtg

SEQ ID NO: 6435 - DNA, 23 bp, Artificial Sequence
  Description of Artificial Sequence: Synthetic oligonucleotide
tccgactcatgcatgagtcggag

SEQ ID NO: 6436 - DNA, 23 bp, Artificial Sequence
  Description of Artificial Sequence: Synthetic oligonucleotide
cgggactcatgcatgagtcccgc

SEQ ID NO: 6437 - DNA, 23 bp, Artificial Sequence
  Description of Artificial Sequence: Synthetic oligonucleotide
agggactcatgcatgagtccctc

SEQ ID NO: 6438 - DNA, 23 bp, Artificial Sequence
  Description of Artificial Sequence: Synthetic oligonucleotide
tgggactcatgcatgagtcccac

SEQ ID NO: 6439 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcatcgatgagtcnnnn

SEQ ID NO: 6440 - DNA, 23 bp, Artificial Sequence
  Description of Artificial Sequence: Synthetic oligonucleotide
gcggactcatcgatgagtccgcc

SEQ ID NO: 6441 - DNA, 23 bp, Artificial Sequence
  Description of Artificial Sequence: Synthetic oligonucleotide
gcggactcatcgatgagtccgct

SEQ ID NO: 6442 - DNA, 23 bp, Artificial Sequence
  Description of Artificial Sequence: Synthetic oligonucleotide
acggactcatcgatgagtccgtc

SEQ ID NO: 6443 - DNA, 23 bp, Artificial Sequence
  Description of Artificial Sequence: Synthetic oligonucleotide
gaggactcatcgatgagtcctcc

SEQ ID NO: 6444 - DNA, 23 bp, Artificial Sequence
  Description of Artificial Sequence: Synthetic oligonucleotide
gcagactcatcgatgagtctgcc

SEQ ID NO: 6445 - DNA, 23 bp, Artificial Sequence
  Description of Artificial Sequence: Synthetic oligonucleotide
gcggactcatcgatgagtccgca

SEQ ID NO: 6446 - DNA, 23 bp, Artificial Sequence
  Description of Artificial Sequence: Synthetic oligonucleotide
tcggactcatcgatgagtccgac

SEQ ID NO: 6447 - DNA, 23 bp, Artificial Sequence
  Description of Artificial Sequence: Synthetic oligonucleotide
gtggactcatcgatgagtccacc

SEQ ID NO: 6448 - DNA, 23 bp, Artificial Sequence
  Description of Artificial Sequence: Synthetic oligonucleotide
gctgactcatcgatgagtcagcc

SEQ ID NO: 6449 - DNA, 23 bp, Artificial Sequence
  Description of Artificial Sequence: Synthetic oligonucleotide
cccgactcatcgatgagtcgggc

SEQ ID NO: 6450 - DNA, 23 bp, Artificial Sequence
  Description of Artificial Sequence: Synthetic oligonucleotide
cccgactcatcgatgagtcgggt

SEQ ID NO: 6451 - DNA, 23 bp, Artificial Sequence
  Description of Artificial Sequence: Synthetic oligonucleotide
accgactcatcgatgagtcggtc

SEQ ID NO: 6452 - DNA, 23 bp, Artificial Sequence
  Description of Artificial Sequence: Synthetic oligonucleotide
cacgactcatcgatgagtcgtgc

SEQ ID NO: 6453 - DNA, 23 bp, Artificial Sequence
  Description of Artificial Sequence: Synthetic oligonucleotide
ccagactcatcgatgagtctggc

SEQ ID NO: 6454 - DNA, 23 bp, Artificial Sequence
  Description of Artificial Sequence: Synthetic oligonucleotide
cccgactcatcgatgagtcggga

SEQ ID NO: 6455 - DNA, 23 bp, Artificial Sequence
  Description of Artificial Sequence: Synthetic oligonucleotide
tccgactcatcgatgagtcggac

SEQ ID NO: 6456 - DNA, 23 bp, Artificial Sequence
  Description of Artificial Sequence: Synthetic oligonucleotide
cctgactcatcgatgagtcaggc

SEQ ID NO: 6457 - DNA, 23 bp, Artificial Sequence
  Description of Artificial Sequence: Synthetic oligonucleotide
ggcgactcatcgatgagtcgccc

SEQ ID NO: 6458 - DNA, 23 bp, Artificial Sequence
  Description of Artificial Sequence: Synthetic oligonucleotide
ggcgactcatcgatgagtcgcct

SEQ ID NO: 6459 - DNA, 23 bp, Artificial Sequence
  Description of Artificial Sequence: Synthetic oligonucleotide
agcgactcatcgatgagtcgctc

SEQ ID NO: 6460 - DNA, 23 bp, Artificial Sequence
  Description of Artificial Sequence: Synthetic oligonucleotide
gacgactcatcgatgagtcgtcc

SEQ ID NO: 6461 - DNA, 23 bp, Artificial Sequence
  Description of Artificial Sequence: Synthetic oligonucleotide
ggagactcatcgatgagtctccc

SEQ ID NO: 6462 - DNA, 23 bp, Artificial Sequence
  Description of Artificial Sequence: Synthetic oligonucleotide
ggcgactcatcgatgagtcgcca

SEQ ID NO: 6463 - DNA, 23 bp, Artificial Sequence
  Description of Artificial Sequence: Synthetic oligonucleotide
tgcgactcatcgatgagtcgcac

SEQ ID NO: 6464 - DNA, 23 bp, Artificial Sequence
  Description of Artificial Sequence: Synthetic oligonucleotide
ggtgactcatcgatgagtcaccc

SEQ ID NO: 6465 - DNA, 23 bp, Artificial Sequence
  Description of Artificial Sequence: Synthetic oligonucleotide
cgggactcatcgatgagtcccgt

SEQ ID NO: 6466 - DNA, 23 bp, Artificial Sequence
  Description of Artificial Sequence: Synthetic oligonucleotide
agggactcatcgatgagtccctg

SEQ ID NO: 6467 - DNA, 23 bp, Artificial Sequence
  Description of Artificial Sequence: Synthetic oligonucleotide
caggactcatcgatgagtcctgg

SEQ ID NO: 6468 - DNA, 23 bp, Artificial Sequence
  Description of Artificial Sequence: Synthetic oligonucleotide
cgagactcatcgatgagtctcgg

SEQ ID NO: 6469 - DNA, 23 bp, Artificial Sequence
  Description of Artificial Sequence: Synthetic oligonucleotide
cgggactcatcgatgagtcccga

SEQ ID NO: 6470 - DNA, 23 bp, Artificial Sequence
  Description of Artificial Sequence: Synthetic oligonucleotide
tgggactcatcgatgagtcccag

SEQ ID NO: 6471 - DNA, 23 bp, Artificial Sequence
  Description of Artificial Sequence: Synthetic oligonucleotide
ctggactcatcgatgagtccagg

SEQ ID NO: 6472 - DNA, 23 bp, Artificial Sequence
  Description of Artificial Sequence: Synthetic oligonucleotide
cgtgactcatcgatgagtcacgg

SEQ ID NO: 6473 - DNA, 23 bp, Artificial Sequence
  Description of Artificial Sequence: Synthetic oligonucleotide
ggcgactcatcgatgagtcgccg

SEQ ID NO: 6474 - DNA, 23 bp, Artificial Sequence
  Description of Artificial Sequence: Synthetic oligonucleotide
agcgactcatcgatgagtcgctg

SEQ ID NO: 6475 - DNA, 23 bp, Artificial Sequence
  Description of Artificial Sequence: Synthetic oligonucleotide
gacgactcatcgatgagtcgtcg

SEQ ID NO: 6476 - DNA, 23 bp, Artificial Sequence
  Description of Artificial Sequence: Synthetic oligonucleotide
ggagactcatcgatgagtctccg

SEQ ID NO: 6477 - DNA, 23 bp, Artificial Sequence
  Description of Artificial Sequence: Synthetic oligonucleotide
tgcgactcatcgatgagtcgcag

SEQ ID NO: 6478 - DNA, 23 bp, Artificial Sequence
  Description of Artificial Sequence: Synthetic oligonucleotide
ggtgactcatcgatgagtcaccg

SEQ ID NO: 6479 - DNA, 23 bp, Artificial Sequence
  Description of Artificial Sequence: Synthetic oligonucleotide
acggactcatcgatgagtccgtg

SEQ ID NO: 6480 - DNA, 23 bp, Artificial Sequence
  Description of Artificial Sequence: Synthetic oligonucleotide
ccagactcatcgatgagtctggg

SEQ ID NO: 6481 - DNA, 23 bp, Artificial Sequence
  Description of Artificial Sequence: Synthetic oligonucleotide
tcggactcatcgatgagtccgag

SEQ ID NO: 6482 - DNA, 23 bp, Artificial Sequence
  Description of Artificial Sequence: Synthetic oligonucleotide
cctgactcatcgatgagtcaggg

SEQ ID NO: 6483 - DNA, 23 bp, Artificial Sequence
  Description of Artificial Sequence: Synthetic oligonucleotide
cacgactcatcgatgagtcgtgg

SEQ ID NO: 6484 - DNA, 23 bp, Artificial Sequence
  Description of Artificial Sequence: Synthetic oligonucleotide
gccgactcatcgatgagtcggct

SEQ ID NO: 6485 - DNA, 23 bp, Artificial Sequence
  Description of Artificial Sequence: Synthetic oligonucleotide
gccgactcatcgatgagtcggca

SEQ ID NO: 6486 - DNA, 23 bp, Artificial Sequence
  Description of Artificial Sequence: Synthetic oligonucleotide
cgagactcatcgatgagtctcgc

SEQ ID NO: 6487 - DNA, 23 bp, Artificial Sequence
  Description of Artificial Sequence: Synthetic oligonucleotide
cgtgactcatcgatgagtcacgc

SEQ ID NO: 6488 - DNA, 23 bp, Artificial Sequence
  Description of Artificial Sequence: Synthetic oligonucleotide
caggactcatcgatgagtcctgc

SEQ ID NO: 6489 - DNA, 23 bp, Artificial Sequence
  Description of Artificial Sequence: Synthetic oligonucleotide
ctggactcatcgatgagtccagc

SEQ ID NO: 6490 - DNA, 23 bp, Artificial Sequence
  Description of Artificial Sequence: Synthetic oligonucleotide
gaggactcatcgatgagtcctcg

SEQ ID NO: 6491 - DNA, 23 bp, Artificial Sequence
  Description of Artificial Sequence: Synthetic oligonucleotide
gtggactcatcgatgagtccacg

SEQ ID NO: 6492 - DNA, 23 bp, Artificial Sequence
  Description of Artificial Sequence: Synthetic oligonucleotide
accgactcatcgatgagtcggtg

SEQ ID NO: 6493 - DNA, 23 bp, Artificial Sequence
  Description of Artificial Sequence: Synthetic oligonucleotide
tccgactcatcgatgagtcggag

SEQ ID NO: 6494 - DNA, 23 bp, Artificial Sequence
  Description of Artificial Sequence: Synthetic oligonucleotide
cgggactcatcgatgagtcccgc

SEQ ID NO: 6495 - DNA, 23 bp, Artificial Sequence
  Description of Artificial Sequence: Synthetic oligonucleotide
agggactcatcgatgagtccctc

SEQ ID NO: 6496 - DNA, 23 bp, Artificial Sequence
  Description of Artificial Sequence: Synthetic oligonucleotide
tgggactcatcgatgagtcccac

SEQ ID NO: 6497 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcttataagagtcnnnn

SEQ ID NO: 6498 - DNA, 23 bp, Artificial Sequence
  Description of Artificial Sequence: Synthetic oligonucleotide
gcggactcttataagagtccgcc

SEQ ID NO: 6499 - DNA, 23 bp, Artificial Sequence
  Description of Artificial Sequence: Synthetic oligonucleotide
gcggactcttataagagtccgct

SEQ ID NO: 6500 - DNA, 23 bp, Artificial Sequence
  Description of Artificial Sequence: Synthetic oligonucleotide
acggactcttataagagtccgtc

SEQ ID NO: 6501 - DNA, 23 bp, Artificial Sequence
  Description of Artificial Sequence: Synthetic oligonucleotide
gaggactcttataagagtcctcc

SEQ ID NO: 6502 - DNA, 23 bp, Artificial Sequence
  Description of Artificial Sequence: Synthetic oligonucleotide
gcagactcttataagagtctgcc

SEQ ID NO: 6503 - DNA, 23 bp, Artificial Sequence
  Description of Artificial Sequence: Synthetic oligonucleotide
gcggactcttataagagtccgca

SEQ ID NO: 6504 - DNA, 23 bp, Artificial Sequence
  Description of Artificial Sequence: Synthetic oligonucleotide
tcggactcttataagagtccgac

SEQ ID NO: 6505 - DNA, 23 bp, Artificial Sequence
  Description of Artificial Sequence: Synthetic oligonucleotide
gtggactcttataagagtccacc

SEQ ID NO: 6506 - DNA, 23 bp, Artificial Sequence
  Description of Artificial Sequence: Synthetic oligonucleotide
gctgactcttataagagtcagcc

SEQ ID NO: 6507 - DNA, 23 bp, Artificial Sequence
  Description of Artificial Sequence: Synthetic oligonucleotide
cccgactcttataagagtcgggc

SEQ ID NO: 6508 - DNA, 23 bp, Artificial Sequence
  Description of Artificial Sequence: Synthetic oligonucleotide
cccgactcttataagagtcgggt

SEQ ID NO: 6509 - DNA, 23 bp, Artificial Sequence
  Description of Artificial Sequence: Synthetic oligonucleotide
accgactcttataagagtcggtc

SEQ ID NO: 6510 - DNA, 23 bp, Artificial Sequence
  Description of Artificial Sequence: Synthetic oligonucleotide
cacgactcttataagagtcgtgc

SEQ ID NO: 6511 - DNA, 23 bp, Artificial Sequence
  Description of Artificial Sequence: Synthetic oligonucleotide
ccagactcttataagagtctggc

SEQ ID NO: 6512 - DNA, 23 bp, Artificial Sequence
  Description of Artificial Sequence: Synthetic oligonucleotide
cccgactcttataagagtcggga

SEQ ID NO: 6513 - DNA, 23 bp, Artificial Sequence
  Description of Artificial Sequence: Synthetic oligonucleotide
tccgactcttataagagtcggac

SEQ ID NO: 6514 - DNA, 23 bp, Artificial Sequence
  Description of Artificial Sequence: Synthetic oligonucleotide
cctgactcttataagagtcaggc

SEQ ID NO: 6515 - DNA, 23 bp, Artificial Sequence
  Description of Artificial Sequence: Synthetic oligonucleotide
ggcgactcttataagagtcgccc

SEQ ID NO: 6516 - DNA, 23 bp, Artificial Sequence
  Description of Artificial Sequence: Synthetic oligonucleotide
ggcgactcttataagagtcgcct

SEQ ID NO: 6517 - DNA, 23 bp, Artificial Sequence
  Description of Artificial Sequence: Synthetic oligonucleotide
agcgactcttataagagtcgctc

SEQ ID NO: 6518 - DNA, 23 bp, Artificial Sequence
  Description of Artificial Sequence: Synthetic oligonucleotide
gacgactcttataagagtcgtcc

SEQ ID NO: 6519 - DNA, 23 bp, Artificial Sequence
  Description of Artificial Sequence: Synthetic oligonucleotide
ggagactcttataagagtctccc

SEQ ID NO: 6520 - DNA, 23 bp, Artificial Sequence
  Description of Artificial Sequence: Synthetic oligonucleotide
ggcgactcttataagagtcgcca

SEQ ID NO: 6521 - DNA, 23 bp, Artificial Sequence
  Description of Artificial Sequence: Synthetic oligonucleotide
tgcgactcttataagagtcgcac

SEQ ID NO: 6522 - DNA, 23 bp, Artificial Sequence
  Description of Artificial Sequence: Synthetic oligonucleotide
ggtgactcttataagagtcaccc

SEQ ID NO: 6523 - DNA, 23 bp, Artificial Sequence
  Description of Artificial Sequence: Synthetic oligonucleotide
cgggactcttataagagtcccgt

SEQ ID NO: 6524 - DNA, 23 bp, Artificial Sequence
  Description of Artificial Sequence: Synthetic oligonucleotide
agggactcttataagagtccctg

SEQ ID NO: 6525 - DNA, 23 bp, Artificial Sequence
  Description of Artificial Sequence: Synthetic oligonucleotide
caggactcttataagagtcctgg

SEQ ID NO: 6526 - DNA, 23 bp, Artificial Sequence
  Description of Artificial Sequence: Synthetic oligonucleotide
cgagactcttataagagtctcgg

SEQ ID NO: 6527 - DNA, 23 bp, Artificial Sequence
  Description of Artificial Sequence: Synthetic oligonucleotide
cgggactcttataagagtcccga

SEQ ID NO: 6528 - DNA, 23 bp, Artificial Sequence
  Description of Artificial Sequence: Synthetic oligonucleotide
tgggactcttataagagtcccag

SEQ ID NO: 6529 - DNA, 23 bp, Artificial Sequence
  Description of Artificial Sequence: Synthetic oligonucleotide
ctggactcttataagagtccagg

SEQ ID NO: 6530 - DNA, 23 bp, Artificial Sequence
  Description of Artificial Sequence: Synthetic oligonucleotide
cgtgactcttataagagtcacgg

SEQ ID NO: 6531 - DNA, 23 bp, Artificial Sequence
  Description of Artificial Sequence: Synthetic oligonucleotide
ggcgactcttataagagtcgccg

SEQ ID NO: 6532 - DNA, 23 bp, Artificial Sequence
  Description of Artificial Sequence: Synthetic oligonucleotide
agcgactcttataagagtcgctg

SEQ ID NO: 6533 - DNA, 23 bp, Artificial Sequence
  Description of Artificial Sequence: Synthetic oligonucleotide
gacgactcttataagagtcgtcg

SEQ ID NO: 6534 - DNA, 23 bp, Artificial Sequence
  Description of Artificial Sequence: Synthetic oligonucleotide
ggagactcttataagagtctccg

SEQ ID NO: 6535 - DNA, 23 bp, Artificial Sequence
  Description of Artificial Sequence: Synthetic oligonucleotide
tgcgactcttataagagtcgcag

SEQ ID NO: 6536 - DNA, 23 bp, Artificial Sequence
  Description of Artificial Sequence: Synthetic oligonucleotide
ggtgactcttataagagtcaccg

SEQ ID NO: 6537 - DNA, 23 bp, Artificial Sequence
  Description of Artificial Sequence: Synthetic oligonucleotide
acggactcttataagagtccgtg

SEQ ID NO: 6538 - DNA, 23 bp, Artificial Sequence
  Description of Artificial Sequence: Synthetic oligonucleotide
ccagactcttataagagtctggg

SEQ ID NO: 6539 - DNA, 23 bp, Artificial Sequence
  Description of Artificial Sequence: Synthetic oligonucleotide
tcggactcttataagagtccgag

SEQ ID NO: 6540 - DNA, 23 bp, Artificial Sequence
  Description of Artificial Sequence: Synthetic oligonucleotide
cctgactcttataagagtcaggg

SEQ ID NO: 6541 - DNA, 23 bp, Artificial Sequence
  Description of Artificial Sequence: Synthetic oligonucleotide
cacgactcttataagagtcgtgg

SEQ ID NO: 6542 - DNA, 23 bp, Artificial Sequence
  Description of Artificial Sequence: Synthetic oligonucleotide
gccgactcttataagagtcggct

SEQ ID NO: 6543 - DNA, 23 bp, Artificial Sequence
  Description of Artificial Sequence: Synthetic oligonucleotide
gccgactcttataagagtcggca

SEQ ID NO: 6544 - DNA, 23 bp, Artificial Sequence
  Description of Artificial Sequence: Synthetic oligonucleotide
cgagactcttataagagtctcgc

SEQ ID NO: 6545 - DNA, 23 bp, Artificial Sequence
  Description of Artificial Sequence: Synthetic oligonucleotide
cgtgactcttataagagtcacgc

SEQ ID NO: 6546 - DNA, 23 bp, Artificial Sequence
  Description of Artificial Sequence: Synthetic oligonucleotide
caggactcttataagagtcctgc

SEQ ID NO: 6547 - DNA, 23 bp, Artificial Sequence
  Description of Artificial Sequence: Synthetic oligonucleotide
ctggactcttataagagtccagc

SEQ ID NO: 6548 - DNA, 23 bp, Artificial Sequence
  Description of Artificial Sequence: Synthetic oligonucleotide
gaggactcttataagagtcctcg

SEQ ID NO: 6549 - DNA, 23 bp, Artificial Sequence
  Description of Artificial Sequence: Synthetic oligonucleotide
gtggactcttataagagtccacg

SEQ ID NO: 6550 - DNA, 23 bp, Artificial Sequence
  Description of Artificial Sequence: Synthetic oligonucleotide
accgactcttataagagtcggtg

SEQ ID NO: 6551 - DNA, 23 bp, Artificial Sequence
  Description of Artificial Sequence: Synthetic oligonucleotide
tccgactcttataagagtcggag

SEQ ID NO: 6552 - DNA, 23 bp, Artificial Sequence
  Description of Artificial Sequence: Synthetic oligonucleotide
cgggactcttataagagtcccgc

SEQ ID NO: 6553 - DNA, 23 bp, Artificial Sequence
  Description of Artificial Sequence: Synthetic oligonucleotide
agggactcttataagagtccctc

SEQ ID NO: 6554 - DNA, 23 bp, Artificial Sequence
  Description of Artificial Sequence: Synthetic oligonucleotide
tgggactcttataagagtcccac

SEQ ID NO: 6555 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactctttaaagagtcnnnn

SEQ ID NO: 6556 - DNA, 23 bp, Artificial Sequence
  Description of Artificial Sequence: Synthetic oligonucleotide
gcggactctttaaagagtccgcc

SEQ ID NO: 6557 - DNA, 23 bp, Artificial Sequence
  Description of Artificial Sequence: Synthetic oligonucleotide
gcggactctttaaagagtccgct

SEQ ID NO: 6558 - DNA, 23 bp, Artificial Sequence
  Description of Artificial Sequence: Synthetic oligonucleotide
acggactctttaaagagtccgtc

SEQ ID NO: 6559 - DNA, 23 bp, Artificial Sequence
  Description of Artificial Sequence: Synthetic oligonucleotide
gaggactctttaaagagtcctcc

SEQ ID NO: 6560 - DNA, 23 bp, Artificial Sequence
  Description of Artificial Sequence: Synthetic oligonucleotide
gcagactctttaaagagtctgcc

SEQ ID NO: 6561 - DNA, 23 bp, Artificial Sequence
  Description of Artificial Sequence: Synthetic oligonucleotide
gcggactctttaaagagtccgca

SEQ ID NO: 6562 - DNA, 23 bp, Artificial Sequence
  Description of Artificial Sequence: Synthetic oligonucleotide
tcggactctttaaagagtccgac

SEQ ID NO: 6563 - DNA, 23 bp, Artificial Sequence
  Description of Artificial Sequence: Synthetic oligonucleotide
gtggactctttaaagagtccacc

SEQ ID NO: 6564 - DNA, 23 bp, Artificial Sequence
  Description of Artificial Sequence: Synthetic oligonucleotide
gctgactctttaaagagtcagcc

SEQ ID NO: 6565 - DNA, 23 bp, Artificial Sequence
  Description of Artificial Sequence: Synthetic oligonucleotide
cccgactctttaaagagtcgggc

SEQ ID NO: 6566 - DNA, 23 bp, Artificial Sequence
  Description of Artificial Sequence: Synthetic oligonucleotide
cccgactctttaaagagtcgggt

SEQ ID NO: 6567 - DNA, 23 bp, Artificial Sequence
  Description of Artificial Sequence: Synthetic oligonucleotide
accgactctttaaagagtcggtc

SEQ ID NO: 6568 - DNA, 23 bp, Artificial Sequence
  Description of Artificial Sequence: Synthetic oligonucleotide
cacgactctttaaagagtcgtgc

SEQ ID NO: 6569 - DNA, 23 bp, Artificial Sequence
  Description of Artificial Sequence: Synthetic oligonucleotide
ccagactctttaaagagtctggc

SEQ ID NO: 6570 - DNA, 23 bp, Artificial Sequence
  Description of Artificial Sequence: Synthetic oligonucleotide
cccgactctttaaagagtcggga

SEQ ID NO: 6571 - DNA, 23 bp, Artificial Sequence
  Description of Artificial Sequence: Synthetic oligonucleotide
tccgactctttaaagagtcggac

SEQ ID NO: 6572 - DNA, 23 bp, Artificial Sequence
  Description of Artificial Sequence: Synthetic oligonucleotide
cctgactctttaaagagtcaggc

SEQ ID NO: 6573 - DNA, 23 bp, Artificial Sequence
  Description of Artificial Sequence: Synthetic oligonucleotide
ggcgactctttaaagagtcgccc

SEQ ID NO: 6574 - DNA, 23 bp, Artificial Sequence
  Description of Artificial Sequence: Synthetic oligonucleotide
ggcgactctttaaagagtcgcct

SEQ ID NO: 6575 - DNA, 23 bp, Artificial Sequence
  Description of Artificial Sequence: Synthetic oligonucleotide
agcgactctttaaagagtcgctc

SEQ ID NO: 6576 - DNA, 23 bp, Artificial Sequence
  Description of Artificial Sequence: Synthetic oligonucleotide
gacgactctttaaagagtcgtcc

SEQ ID NO: 6577 - DNA, 23 bp, Artificial Sequence
  Description of Artificial Sequence: Synthetic oligonucleotide
ggagactctttaaagagtctccc

SEQ ID NO: 6578 - DNA, 23 bp, Artificial Sequence
  Description of Artificial Sequence: Synthetic oligonucleotide
ggcgactctttaaagagtcgcca

SEQ ID NO: 6579 - DNA, 23 bp, Artificial Sequence
  Description of Artificial Sequence: Synthetic oligonucleotide
tgcgactctttaaagagtcgcac

SEQ ID NO: 6580 - DNA, 23 bp, Artificial Sequence
  Description of Artificial Sequence: Synthetic oligonucleotide
ggtgactctttaaagagtcaccc

SEQ ID NO: 6581 - DNA, 23 bp, Artificial Sequence
  Description of Artificial Sequence: Synthetic oligonucleotide
cgggactctttaaagagtcccgt

SEQ ID NO: 6582 - DNA, 23 bp, Artificial Sequence
  Description of Artificial Sequence: Synthetic oligonucleotide
agggactctttaaagagtccctg

SEQ ID NO: 6583 - DNA, 23 bp, Artificial Sequence
  Description of Artificial Sequence: Synthetic oligonucleotide
caggactctttaaagagtcctgg

SEQ ID NO: 6584 - DNA, 23 bp, Artificial Sequence
  Description of Artificial Sequence: Synthetic oligonucleotide
cgagactctttaaagagtctcgg

SEQ ID NO: 6585 - DNA, 23 bp, Artificial Sequence
  Description of Artificial Sequence: Synthetic oligonucleotide
cgggactctttaaagagtcccga

SEQ ID NO: 6586 - DNA, 23 bp, Artificial Sequence
  Description of Artificial Sequence: Synthetic oligonucleotide
tgggactctttaaagagtcccag

SEQ ID NO: 6587 - DNA, 23 bp, Artificial Sequence
  Description of Artificial Sequence: Synthetic oligonucleotide
ctggactctttaaagagtccagg

SEQ ID NO: 6588 - DNA, 23 bp, Artificial Sequence
  Description of Artificial Sequence: Synthetic oligonucleotide
cgtgactctttaaagagtcacgg

SEQ ID NO: 6589 - DNA, 23 bp, Artificial Sequence
  Description of Artificial Sequence: Synthetic oligonucleotide
ggcgactctttaaagagtcgccg

SEQ ID NO: 6590 - DNA, 23 bp, Artificial Sequence
  Description of Artificial Sequence: Synthetic oligonucleotide
agcgactctttaaagagtcgctg

SEQ ID NO: 6591 - DNA, 23 bp, Artificial Sequence
  Description of Artificial Sequence: Synthetic oligonucleotide
gacgactctttaaagagtcgtcg

SEQ ID NO: 6592 - DNA, 23 bp, Artificial Sequence
  Description of Artificial Sequence: Synthetic oligonucleotide
ggagactctttaaagagtctccg

SEQ ID NO: 6593 - DNA, 23 bp, Artificial Sequence
  Description of Artificial Sequence: Synthetic oligonucleotide
tgcgactctttaaagagtcgcag

SEQ ID NO: 6594 - DNA, 23 bp, Artificial Sequence
  Description of Artificial Sequence: Synthetic oligonucleotide
ggtgactctttaaagagtcaccg

SEQ ID NO: 6595 - DNA, 23 bp, Artificial Sequence
  Description of Artificial Sequence: Synthetic oligonucleotide
acggactctttaaagagtccgtg

SEQ ID NO: 6596 - DNA, 23 bp, Artificial Sequence
  Description of Artificial Sequence: Synthetic oligonucleotide
ccagactctttaaagagtctggg

SEQ ID NO: 6597 - DNA, 23 bp, Artificial Sequence
  Description of Artificial Sequence: Synthetic oligonucleotide
tcggactctttaaagagtccgag

SEQ ID NO: 6598 - DNA, 23 bp, Artificial Sequence
  Description of Artificial Sequence: Synthetic oligonucleotide
cctgactctttaaagagtcaggg

SEQ ID NO: 6599 - DNA, 23 bp, Artificial Sequence
  Description of Artificial Sequence: Synthetic oligonucleotide
cacgactctttaaagagtcgtgg

SEQ ID NO: 6600 - DNA, 23 bp, Artificial Sequence
  Description of Artificial Sequence: Synthetic oligonucleotide
gccgactctttaaagagtcggct

SEQ ID NO: 6601 - DNA, 23 bp, Artificial Sequence
  Description of Artificial Sequence: Synthetic oligonucleotide
gccgactctttaaagagtcggca

SEQ ID NO: 6602 - DNA, 23 bp, Artificial Sequence
  Description of Artificial Sequence: Synthetic oligonucleotide
cgagactctttaaagagtctcgc

SEQ ID NO: 6603 - DNA, 23 bp, Artificial Sequence
  Description of Artificial Sequence: Synthetic oligonucleotide
cgtgactctttaaagagtcacgc

SEQ ID NO: 6604 - DNA, 23 bp, Artificial Sequence
  Description of Artificial Sequence: Synthetic oligonucleotide
caggactctttaaagagtcctgc

SEQ ID NO: 6605 - DNA, 23 bp, Artificial Sequence
  Description of Artificial Sequence: Synthetic oligonucleotide
ctggactctttaaagagtccagc

SEQ ID NO: 6606 - DNA, 23 bp, Artificial Sequence
  Description of Artificial Sequence: Synthetic oligonucleotide
gaggactctttaaagagtcctcg

SEQ ID NO: 6607 - DNA, 23 bp, Artificial Sequence
  Description of Artificial Sequence: Synthetic oligonucleotide
gtggactctttaaagagtccacg

SEQ ID NO: 6608 - DNA, 23 bp, Artificial Sequence
  Description of Artificial Sequence: Synthetic oligonucleotide
accgactctttaaagagtcggtg

SEQ ID NO: 6609 - DNA, 23 bp, Artificial Sequence
  Description of Artificial Sequence: Synthetic oligonucleotide
tccgactctttaaagagtcggag

SEQ ID NO: 6610 - DNA, 23 bp, Artificial Sequence
  Description of Artificial Sequence: Synthetic oligonucleotide
cgggactctttaaagagtcccgc

SEQ ID NO: 6611 - DNA, 23 bp, Artificial Sequence
  Description of Artificial Sequence: Synthetic oligonucleotide
agggactctttaaagagtccctc

SEQ ID NO: 6612 - DNA, 23 bp, Artificial Sequence
  Description of Artificial Sequence: Synthetic oligonucleotide
tgggactctttaaagagtcccac

SEQ ID NO: 6613 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcttgcaagagtcnnnn

SEQ ID NO: 6614 - DNA, 23 bp, Artificial Sequence
  Description of Artificial Sequence: Synthetic oligonucleotide
gcggactcttgcaagagtccgcc

SEQ ID NO: 6615 - DNA, 23 bp, Artificial Sequence
  Description of Artificial Sequence: Synthetic oligonucleotide
gcggactcttgcaagagtccgct

SEQ ID NO: 6616 - DNA, 23 bp, Artificial Sequence
  Description of Artificial Sequence: Synthetic oligonucleotide
acggactcttgcaagagtccgtc

SEQ ID NO: 6617 - DNA, 23 bp, Artificial Sequence
  Description of Artificial Sequence: Synthetic oligonucleotide
gaggactcttgcaagagtcctcc

SEQ ID NO: 6618 - DNA, 23 bp, Artificial Sequence
  Description of Artificial Sequence: Synthetic oligonucleotide
gcagactcttgcaagagtctgcc

SEQ ID NO: 6619 - DNA, 23 bp, Artificial Sequence
  Description of Artificial Sequence: Synthetic oligonucleotide
gcggactcttgcaagagtccgca

SEQ ID NO: 6620 - DNA, 23 bp, Artificial Sequence
  Description of Artificial Sequence: Synthetic oligonucleotide
tcggactcttgcaagagtccgac

SEQ ID NO: 6621 - DNA, 23 bp, Artificial Sequence
  Description of Artificial Sequence: Synthetic oligonucleotide
gtggactcttgcaagagtccacc

SEQ ID NO: 6622 - DNA, 23 bp, Artificial Sequence
  Description of Artificial Sequence: Synthetic oligonucleotide
gctgactcttgcaagagtcagcc

SEQ ID NO: 6623 - DNA, 23 bp, Artificial Sequence
  Description of Artificial Sequence: Synthetic oligonucleotide
cccgactcttgcaagagtcgggc

SEQ ID NO: 6624 - DNA, 23 bp, Artificial Sequence
  Description of Artificial Sequence: Synthetic oligonucleotide
cccgactcttgcaagagtcgggt

SEQ ID NO: 6625 - DNA, 23 bp, Artificial Sequence
  Description of Artificial Sequence: Synthetic oligonucleotide
accgactcttgcaagagtcggtc

SEQ ID NO: 6626 - DNA, 23 bp, Artificial Sequence
  Description of Artificial Sequence: Synthetic oligonucleotide
cacgactcttgcaagagtcgtgc

SEQ ID NO: 6627 - DNA, 23 bp, Artificial Sequence
  Description of Artificial Sequence: Synthetic oligonucleotide
ccagactcttgcaagagtctggc

SEQ ID NO: 6628 - DNA, 23 bp, Artificial Sequence
  Description of Artificial Sequence: Synthetic oligonucleotide
cccgactcttgcaagagtcggga

SEQ ID NO: 6629 - DNA, 23 bp, Artificial Sequence
  Description of Artificial Sequence: Synthetic oligonucleotide
tccgactcttgcaagagtcggac

SEQ ID NO: 6630 - DNA, 23 bp, Artificial Sequence
  Description of Artificial Sequence: Synthetic oligonucleotide
cctgactcttgcaagagtcaggc

SEQ ID NO: 6631 - DNA, 23 bp, Artificial Sequence
  Description of Artificial Sequence: Synthetic oligonucleotide
ggcgactcttgcaagagtcgccc

SEQ ID NO: 6632 - DNA, 23 bp, Artificial Sequence
  Description of Artificial Sequence: Synthetic oligonucleotide
ggcgactcttgcaagagtcgcct

SEQ ID NO: 6633 - DNA, 23 bp, Artificial Sequence
  Description of Artificial Sequence: Synthetic oligonucleotide
agcgactcttgcaagagtcgctc

SEQ ID NO: 6634 - DNA, 23 bp, Artificial Sequence
  Description of Artificial Sequence: Synthetic oligonucleotide
gacgactcttgcaagagtcgtcc

SEQ ID NO: 6635 - DNA, 23 bp, Artificial Sequence
  Description of Artificial Sequence: Synthetic oligonucleotide
ggagactcttgcaagagtctccc

SEQ ID NO: 6636 - DNA, 23 bp, Artificial Sequence
  Description of Artificial Sequence: Synthetic oligonucleotide
ggcgactcttgcaagagtcgcca

SEQ ID NO: 6637 - DNA, 23 bp, Artificial Sequence
  Description of Artificial Sequence: Synthetic oligonucleotide
tgcgactcttgcaagagtcgcac

SEQ ID NO: 6638 - DNA, 23 bp, Artificial Sequence
  Description of Artificial Sequence: Synthetic oligonucleotide
ggtgactcttgcaagagtcaccc

SEQ ID NO: 6639 - DNA, 23 bp, Artificial Sequence
  Description of Artificial Sequence: Synthetic oligonucleotide
cgggactcttgcaagagtcccgt

SEQ ID NO: 6640 - DNA, 23 bp, Artificial Sequence
  Description of Artificial Sequence: Synthetic oligonucleotide
agggactcttgcaagagtccctg

SEQ ID NO: 6641 - DNA, 23 bp, Artificial Sequence
  Description of Artificial Sequence: Synthetic oligonucleotide
caggactcttgcaagagtcctgg

SEQ ID NO: 6642 - DNA, 23 bp, Artificial Sequence
  Description of Artificial Sequence: Synthetic oligonucleotide
cgagactcttgcaagagtctcgg

SEQ ID NO: 6643 - DNA, 23 bp, Artificial Sequence
  Description of Artificial Sequence: Synthetic oligonucleotide
cgggactcttgcaagagtcccga

SEQ ID NO: 6644 - DNA, 23 bp, Artificial Sequence
  Description of Artificial Sequence: Synthetic oligonucleotide
tgggactcttgcaagagtcccag

SEQ ID NO: 6645 - DNA, 23 bp, Artificial Sequence
  Description of Artificial Sequence: Synthetic oligonucleotide
ctggactcttgcaagagtccagg

SEQ ID NO: 6646 - DNA, 23 bp, Artificial Sequence
  Description of Artificial Sequence: Synthetic oligonucleotide
cgtgactcttgcaagagtcacgg

SEQ ID NO: 6647 - DNA, 23 bp, Artificial Sequence
  Description of Artificial Sequence: Synthetic oligonucleotide
ggcgactcttgcaagagtcgccg

SEQ ID NO: 6648 - DNA, 23 bp, Artificial Sequence
  Description of Artificial Sequence: Synthetic oligonucleotide
agcgactcttgcaagagtcgctg

SEQ ID NO: 6649 - DNA, 23 bp, Artificial Sequence
  Description of Artificial Sequence: Synthetic oligonucleotide
gacgactcttgcaagagtcgtcg

SEQ ID NO: 6650 - DNA, 23 bp, Artificial Sequence
  Description of Artificial Sequence: Synthetic oligonucleotide
ggagactcttgcaagagtctccg

SEQ ID NO: 6651 - DNA, 23 bp, Artificial Sequence
  Description of Artificial Sequence: Synthetic oligonucleotide
tgcgactcttgcaagagtcgcag

SEQ ID NO: 6652 - DNA, 23 bp, Artificial Sequence
  Description of Artificial Sequence: Synthetic oligonucleotide
ggtgactcttgcaagagtcaccg

SEQ ID NO: 6653 - DNA, 23 bp, Artificial Sequence
  Description of Artificial Sequence: Synthetic oligonucleotide
acggactcttgcaagagtccgtg

SEQ ID NO: 6654 - DNA, 23 bp, Artificial Sequence
  Description of Artificial Sequence: Synthetic oligonucleotide
ccagactcttgcaagagtctggg

SEQ ID NO: 6655 - DNA, 23 bp, Artificial Sequence
  Description of Artificial Sequence: Synthetic oligonucleotide
tcggactcttgcaagagtccgag

SEQ ID NO: 6656 - DNA, 23 bp, Artificial Sequence
  Description of Artificial Sequence: Synthetic oligonucleotide
cctgactcttgcaagagtcaggg

SEQ ID NO: 6657 - DNA, 23 bp, Artificial Sequence
  Description of Artificial Sequence: Synthetic oligonucleotide
cacgactcttgcaagagtcgtgg

SEQ ID NO: 6658 - DNA, 23 bp, Artificial Sequence
  Description of Artificial Sequence: Synthetic oligonucleotide
gccgactcttgcaagagtcggct

SEQ ID NO: 6659 - DNA, 23 bp, Artificial Sequence
  Description of Artificial Sequence: Synthetic oligonucleotide
gccgactcttgcaagagtcggca

SEQ ID NO: 6660 - DNA, 23 bp, Artificial Sequence
  Description of Artificial Sequence: Synthetic oligonucleotide
cgagactcttgcaagagtctcgc

SEQ ID NO: 6661 - DNA, 23 bp, Artificial Sequence
  Description of Artificial Sequence: Synthetic oligonucleotide
cgtgactcttgcaagagtcacgc

SEQ ID NO: 6662 - DNA, 23 bp, Artificial Sequence
  Description of Artificial Sequence: Synthetic oligonucleotide
caggactcttgcaagagtcctgc

SEQ ID NO: 6663 - DNA, 23 bp, Artificial Sequence
  Description of Artificial Sequence: Synthetic oligonucleotide
ctggactcttgcaagagtccagc

SEQ ID NO: 6664 - DNA, 23 bp, Artificial Sequence
  Description of Artificial Sequence: Synthetic oligonucleotide
gaggactcttgcaagagtcctcg

SEQ ID NO: 6665 - DNA, 23 bp, Artificial Sequence
  Description of Artificial Sequence: Synthetic oligonucleotide
gtggactcttgcaagagtccacg

SEQ ID NO: 6666 - DNA, 23 bp, Artificial Sequence
  Description of Artificial Sequence: Synthetic oligonucleotide
accgactcttgcaagagtcggtg

SEQ ID NO: 6667 - DNA, 23 bp, Artificial Sequence
  Description of Artificial Sequence: Synthetic oligonucleotide
tccgactcttgcaagagtcggag

SEQ ID NO: 6668 - DNA, 23 bp, Artificial Sequence
  Description of Artificial Sequence: Synthetic oligonucleotide
cgggactcttgcaagagtcccgc

SEQ ID NO: 6669 - DNA, 23 bp, Artificial Sequence
  Description of Artificial Sequence: Synthetic oligonucleotide
agggactcttgcaagagtccctc

SEQ ID NO: 6670 - DNA, 23 bp, Artificial Sequence
  Description of Artificial Sequence: Synthetic oligonucleotide
tgggactcttgcaagagtcccac

SEQ ID NO: 6671 - DNA, 23 bp, Artificial Sequence
  Description of Artificial Sequence: Synthetic oligonucleotide
  modified_base (1)..(3): a, c, t, or g
  modified_base (20)..(23): a, c, t, or g
nnngactcttcgaagagtcnnnn

SEQ ID NO: 6672 - DNA, 23 bp, Artificial Sequence
  Description of Artificial Sequence: Synthetic oligonucleotide
gcggactcttcgaagagtccgcc

SEQ ID NO: 6673 - DNA, 23 bp, Artificial Sequence
  Description of Artificial Sequence: Synthetic oligonucleotide
gcggactcttcgaagagtccgct

SEQ ID NO: 6674 - DNA, 23 bp, Artificial Sequence
  Description of Artificial Sequence: Synthetic oligonucleotide
acggactcttcgaagagtccgtc

SEQ ID NO: 6675 - DNA, 23 bp, Artificial Sequence
  Description of Artificial Sequence: Synthetic oligonucleotide
gaggactcttcgaagagtcctcc

SEQ ID NO: 6676 - DNA, 23 bp, Artificial Sequence
  Description of Artificial Sequence: Synthetic oligonucleotide
gcagactcttcgaagagtctgcc

SEQ ID NO: 6677 - DNA, 23 bp, Artificial Sequence
  Description of Artificial Sequence: Synthetic oligonucleotide
gcggactcttcgaagagtccgca

SEQ ID NO: 6678 - DNA, 23 bp, Artificial Sequence
  Description of Artificial Sequence: Synthetic oligonucleotide
tcggactcttcgaagagtccgac

SEQ ID NO: 6679 - DNA, 23 bp, Artificial Sequence
  Description of Artificial Sequence: Synthetic oligonucleotide
gtggactcttcgaagagtccacc

SEQ ID NO: 6680 - DNA, 23 bp, Artificial Sequence
  Description of Artificial Sequence: Synthetic oligonucleotide
gctgactcttcgaagagtcagcc

SEQ ID NO: 6681 - DNA, 23 bp, Artificial Sequence
  Description of Artificial Sequence: Synthetic oligonucleotide
cccgactcttcgaagagtcgggc

SEQ ID NO: 6682 - DNA, 23 bp, Artificial Sequence
  Description of Artificial Sequence: Synthetic oligonucleotide
cccgactcttcgaagagtcgggt

SEQ ID NO: 6683 - DNA, 23 bp, Artificial Sequence
  Description of Artificial Sequence: Synthetic oligonucleotide
accgactcttcgaagagtcggtc

SEQ ID NO: 6684 - DNA, 23 bp, Artificial Sequence
  Description of Artificial Sequence: Synthetic oligonucleotide
cacgactcttcgaagagtcgtgc

SEQ ID NO: 6685 - DNA, 23 bp, Artificial Sequence
  Description of Artificial Sequence: Synthetic oligonucleotide
ccagactcttcgaagagtctggc

SEQ ID NO: 6686 - DNA, 23 bp, Artificial Sequence
  Description of Artificial Sequence: Synthetic oligonucleotide
cccgactcttcgaagagtcggga

SEQ ID NO: 6687 - DNA, 23 bp, Artificial Sequence
  Description of Artificial Sequence: Synthetic oligonucleotide
tccgactcttcgaagagtcggac

SEQ ID NO: 6688 - DNA, 23 bp, Artificial Sequence
  Description of Artificial Sequence: Synthetic oligonucleotide
cctgactcttcgaagagtcaggc

SEQ ID NO: 6689 - DNA, 23 bp, Artificial Sequence
  Description of Artificial Sequence: Synthetic oligonucleotide
ggcgactcttcgaagagtcgccc

SEQ ID NO: 6690 - DNA, 23 bp, Artificial Sequence
  Description of Artificial Sequence: Synthetic oligonucleotide
ggcgactcttcgaagagtcgcct

SEQ ID NO: 6691 - DNA, 23 bp, Artificial Sequence
  Description of Artificial Sequence: Synthetic oligonucleotide
agcgactcttcgaagagtcgctc

SEQ ID NO: 6692 - DNA, 23 bp, Artificial Sequence
  Description of Artificial Sequence: Synthetic oligonucleotide
gacgactcttcgaagagtcgtcc

SEQ ID NO: 6693 - DNA, 23 bp, Artificial Sequence
  Description of Artificial Sequence: Synthetic oligonucleotide
ggagactcttcgaagagtctccc

SEQ ID NO: 6694 - DNA, 23 bp, Artificial Sequence
  Description of Artificial Sequence: Synthetic oligonucleotide
ggcgactcttcgaagagtcgcca

SEQ ID NO: 6695 - DNA, 23 bp, Artificial Sequence
  Description of Artificial Sequence: Synthetic oligonucleotide
tgcgactcttcgaagagtcgcac

SEQ ID NO: 6696 - DNA, 23 bp, Artificial Sequence
  Description of Artificial Sequence: Synthetic oligonucleotide
ggtgactcttcgaagagtcaccc

SEQ ID NO: 6697 - DNA, 23 bp, Artificial Sequence
  Description of Artificial Sequence: Synthetic oligonucleotide
cgggactcttcgaagagtcccgt

SEQ ID NO: 6698 - DNA, 23 bp, Artificial Sequence
  Description of Artificial Sequence: Synthetic oligonucleotide
agggactcttcgaagagtccctg

SEQ ID NO: 6699 - DNA, 23 bp, Artificial Sequence
  Description of Artificial Sequence: Synthetic oligonucleotide
caggactcttcgaagagtcctgg

SEQ ID NO: 6700 - DNA, 23 bp, Artificial Sequence
  Description of Artificial Sequence: Synthetic oligonucleotide
cgagactcttcgaagagtctcgg

SEQ ID NO: 6701 - DNA, 23 bp, Artificial Sequence
  Description of Artificial Sequence: Synthetic oligonucleotide
cgggactcttcgaagagtcccga

SEQ ID NO: 6702 - DNA, 23 bp, Artificial Sequence
  Description of Artificial Sequence: Synthetic oligonucleotide
tgggactcttcgaagagtcccag

SEQ ID NO: 6703 - DNA, 23 bp, Artificial Sequence
  Description of Artificial Sequence: Synthetic oligonucleotide
ctggactcttcgaagagtccagg

SEQ ID NO: 6704 - DNA, 23 bp, Artificial Sequence
  Description of Artificial Sequence: Synthetic oligonucleotide
cgtgactcttcgaagagtcacgg

SEQ ID NO: 6705 - DNA, 23 bp, Artificial Sequence
  Description of Artificial Sequence: Synthetic oligonucleotide
ggcgactcttcgaagagtcgccg

SEQ ID NO: 6706 - DNA, 23 bp, Artificial Sequence
  Description of Artificial Sequence: Synthetic oligonucleotide
agcgactcttcgaagagtcgctg

SEQ ID NO: 6707 - DNA, 23 bp, Artificial Sequence
  Description of Artificial Sequence: Synthetic oligonucleotide
gacgactcttcgaagagtcgtcg

SEQ ID NO: 6708 - DNA, 23 bp, Artificial Sequence
  Description of Artificial Sequence: Synthetic oligonucleotide
ggagactcttcgaagagtctccg

SEQ ID NO: 6709 - DNA, 23 bp, Artificial Sequence
  Description of Artificial Sequence: Synthetic oligonucleotide
tgcgactcttcgaagagtcgcag

SEQ ID NO: 6710 - DNA, 23 bp, Artificial Sequence
  Description of Artificial Sequence: Synthetic oligonucleotide
ggtgactcttcgaagagtcaccg

SEQ ID NO: 6711 - DNA, 23 bp, Artificial Sequence
  Description of Artificial Sequence: Synthetic oligonucleotide
acggactcttcgaagagtccgtg

SEQ ID NO: 6712 - DNA, 23 bp, Artificial Sequence
  Description of Artificial Sequence: Synthetic oligonucleotide
ccagactcttcgaagagtctggg

SEQ ID NO: 6713 - DNA, 23 bp, Artificial Sequence
  Description of Artificial Sequence: Synthetic oligonucleotide
tcggactcttcgaagagtccgag

SEQ ID NO: 6714 - DNA, 23 bp, Artificial Sequence
  Description of Artificial Sequence: Synthetic oligonucleotide
cctgactcttcgaagagtcaggg

SEQ ID NO: 6715 - DNA, 23 bp, Artificial Sequence
  Description of Artificial Sequence: Synthetic oligonucleotide
cacgactcttcgaagagtcgtgg

SEQ ID NO: 6716 - DNA, 23 bp, Artificial Sequence
  Description of Artificial Sequence: Synthetic oligonucleotide
gccgactcttcgaagagtcggct

SEQ ID NO: 6717 - DNA, 23 bp, Artificial Sequence
  Description of Artificial Sequence: Synthetic oligonucleotide
gccgactcttcgaagagtcggca

SEQ ID NO: 6718 - DNA, 23 bp, Artificial Sequence
  Description of Artificial Sequence: Synthetic oligonucleotide
cgagactcttcgaagagtctcgc

SEQ ID NO: 6719 - DNA, 23 bp, Artificial Sequence
  Description of Artificial Sequence: Synthetic oligonucleotide
cgtgactcttcgaagagtcacgc

SEQ ID NO: 6720 - DNA, 23 bp, Artificial Sequence
  Description of Artificial Sequence: Synthetic oligonucleotide
caggactcttcgaagagtcctgc

SEQ ID NO: 6721 - DNA, 23 bp, Artificial Sequence
  Description of Artificial Sequence: Synthetic oligonucleotide
ctggactcttcgaagagtccagc

SEQ ID NO: 6722 - DNA, 23 bp, Artificial Sequence
  Description of Artificial Sequence: Synthetic oligonucleotide
gaggactcttcgaagagtcctcg

SEQ ID NO: 6723 - DNA, 23 bp, Artificial Sequence
  Description of Artificial Sequence: Synthetic oligonucleotide
gtggactcttcgaagagtccacg

SEQ ID NO: 6724 - DNA, 23 bp, Artificial Sequence
  Description of Artificial Sequence: Synthetic oligonucleotide
accgactcttcgaagagtcggtg

SEQ ID NO: 6725 - DNA, 23 bp, Artificial Sequence
  Description of Artificial Sequence: Synthetic oligonucleotide
tccgactcttcgaagagtcggag

SEQ ID NO: 6726 - DNA, 23 bp, Artificial Sequence
  Description of Artificial Sequence: Synthetic oligonucleotide
cgggactcttcgaagagtcccgc

SEQ ID NO: 6727 - DNA, 23 bp, Artificial Sequence
  Description of Artificial Sequence: Synthetic oligonucleotide
agggactcttcgaagagtccctc

SEQ ID NO: 6728 - DNA, 23 bp, Artificial Sequence
  Description of Artificial Sequence: Synthetic oligonucleotide
tgggactcttcgaagagtcccac

SEQ ID NO: 6729 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccgatcggagtcnnnn

SEQ ID NO: 6730 - DNA, 22 bp, Artificial Sequence
  Description of Artificial Sequence: Synthetic oligonucleotide
cggactccgatcggagtccgcc

SEQ ID NO: 6731 - DNA, 22 bp, Artificial Sequence
  Description of Artificial Sequence: Synthetic oligonucleotide
cggactccgatcggagtccgct

SEQ ID NO: 6732 - DNA, 22 bp, Artificial Sequence
  Description of Artificial Sequence: Synthetic oligonucleotide
cggactccgatcggagtccgtc

SEQ ID NO: 6733 - DNA, 22 bp, Artificial Sequence
  Description of Artificial Sequence: Synthetic oligonucleotide
aggactccgatcggagtcctcc

SEQ ID NO: 6734 - DNA, 22 bp, Artificial Sequence
  Description of Artificial Sequence: Synthetic oligonucleotide
cagactccgatcggagtctgcc

SEQ ID NO: 6735 - DNA, 22 bp, Artificial Sequence
  Description of Artificial Sequence: Synthetic oligonucleotide
cggactccgatcggagtccgca

SEQ ID NO: 6736 - DNA, 22 bp, Artificial Sequence
  Description of Artificial Sequence: Synthetic oligonucleotide
cggactccgatcggagtccgac

SEQ ID NO: 6737 - DNA, 22 bp, Artificial Sequence
  Description of Artificial Sequence: Synthetic oligonucleotide
tggactccgatcggagtccacc

SEQ ID NO: 6738 - DNA, 22 bp, Artificial Sequence
  Description of Artificial Sequence: Synthetic oligonucleotide
ctgactccgatcggagtcagcc

SEQ ID NO: 6739 - DNA, 22 bp, Artificial Sequence
  Description of Artificial Sequence: Synthetic oligonucleotide
ccgactccgatcggagtcgggc

SEQ ID NO: 6740 - DNA, 22 bp, Artificial Sequence
  Description of Artificial Sequence: Synthetic oligonucleotide
ccgactccgatcggagtcgggt

SEQ ID NO: 6741 - DNA, 22 bp, Artificial Sequence
  Description of Artificial Sequence: Synthetic oligonucleotide
ccgactccgatcggagtcggtc

SEQ ID NO: 6742 - DNA, 22 bp, Artificial Sequence
  Description of Artificial Sequence: Synthetic oligonucleotide
acgactccgatcggagtcgtgc

SEQ ID NO: 6743 - DNA, 22 bp, Artificial Sequence
  Description of Artificial Sequence: Synthetic oligonucleotide
cagactccgatcggagtctggc

SEQ ID NO: 6744 - DNA, 22 bp, Artificial Sequence
  Description of Artificial Sequence: Synthetic oligonucleotide
ccgactccgatcggagtcggga

SEQ ID NO: 6745 - DNA, 22 bp, Artificial Sequence
  Description of Artificial Sequence: Synthetic oligonucleotide
ccgactccgatcggagtcggac

SEQ ID NO: 6746 - DNA, 22 bp, Artificial Sequence
  Description of Artificial Sequence: Synthetic oligonucleotide
ctgactccgatcggagtcaggc

SEQ ID NO: 6747 - DNA, 22 bp, Artificial Sequence
  Description of Artificial Sequence: Synthetic oligonucleotide
gcgactccgatcggagtcgccc

SEQ ID NO: 6748 - DNA, 22 bp, Artificial Sequence
  Description of Artificial Sequence: Synthetic oligonucleotide
gcgactccgatcggagtcgcct

SEQ ID NO: 6749 - DNA, 22 bp, Artificial Sequence
  Description of Artificial Sequence: Synthetic oligonucleotide
gcgactccgatcggagtcgctc

SEQ ID NO: 6750 - DNA, 22 bp, Artificial Sequence
  Description of Artificial Sequence: Synthetic oligonucleotide
acgactccgatcggagtcgtcc

SEQ ID NO: 6751 - DNA, 22 bp, Artificial Sequence
  Description of Artificial Sequence: Synthetic oligonucleotide
gagactccgatcggagtctccc

SEQ ID NO: 6752 - DNA, 22 bp, Artificial Sequence
  Description of Artificial Sequence: Synthetic oligonucleotide
gcgactccgatcggagtcgcca

SEQ ID NO: 6753 - DNA, 22 bp, Artificial Sequence
  Description of Artificial Sequence: Synthetic oligonucleotide
gcgactccgatcggagtcgcac

SEQ ID NO: 6754 - DNA, 22 bp, Artificial Sequence
  Description of Artificial Sequence: Synthetic oligonucleotide
gtgactccgatcggagtcaccc

SEQ ID NO: 6755 - DNA, 22 bp, Artificial Sequence
  Description of Artificial Sequence: Synthetic oligonucleotide
gggactccgatcggagtcccgt

SEQ ID NO: 6756 - DNA, 22 bp, Artificial Sequence
  Description of Artificial Sequence: Synthetic oligonucleotide
gggactccgatcggagtccctg

SEQ ID NO: 6757 - DNA, 22 bp, Artificial Sequence
  Description of Artificial Sequence: Synthetic oligonucleotide
aggactccgatcggagtcctgg

SEQ ID NO: 6758 - DNA, 22 bp, Artificial Sequence
  Description of Artificial Sequence: Synthetic oligonucleotide
gagactccgatcggagtctcgg

SEQ ID NO: 6759 - DNA, 22 bp, Artificial Sequence
  Description of Artificial Sequence: Synthetic oligonucleotide
gggactccgatcggagtcccga

SEQ ID NO: 6760 - DNA, 22 bp, Artificial Sequence
  Description of Artificial Sequence: Synthetic oligonucleotide
gggactccgatcggagtcccag

SEQ ID NO: 6761 - DNA, 22 bp, Artificial Sequence
  Description of Artificial Sequence: Synthetic oligonucleotide
tggactccgatcggagtccagg

SEQ ID NO: 6762 - DNA, 22 bp, Artificial Sequence
  Description of Artificial Sequence: Synthetic oligonucleotide
gtgactccgatcggagtcacgg

SEQ ID NO: 6763 - DNA, 22 bp, Artificial Sequence
  Description of Artificial Sequence: Synthetic oligonucleotide
gcgactccgatcggagtcgccg

SEQ ID NO: 6764 - DNA, 22 bp, Artificial Sequence
  Description of Artificial Sequence: Synthetic oligonucleotide
gcgactccgatcggagtcgctg

SEQ ID NO: 6765 - DNA, 22 bp, Artificial Sequence
  Description of Artificial Sequence: Synthetic oligonucleotide
acgactccgatcggagtcgtcg

SEQ ID NO: 6766 - DNA, 22 bp, Artificial Sequence
  Description of Artificial Sequence: Synthetic oligonucleotide
gagactccgatcggagtctccg

SEQ ID NO: 6767 - DNA, 22 bp, Artificial Sequence
  Description of Artificial Sequence: Synthetic oligonucleotide
gcgactccgatcggagtcgcag

SEQ ID NO: 6768 - DNA, 22 bp, Artificial Sequence
  Description of Artificial Sequence: Synthetic oligonucleotide
gtgactccgatcggagtcaccg

SEQ ID NO: 6769 - DNA, 22 bp, Artificial Sequence
  Description of Artificial Sequence: Synthetic oligonucleotide
cggactccgatcggagtccgtg

SEQ ID NO: 6770 - DNA, 22 bp, Artificial Sequence
  Description of Artificial Sequence: Synthetic oligonucleotide
cagactccgatcggagtctggg

SEQ ID NO: 6771 - DNA, 22 bp, Artificial Sequence
  Description of Artificial Sequence: Synthetic oligonucleotide
cggactccgatcggagtccgag

SEQ ID NO: 6772 - DNA, 22 bp, Artificial Sequence
  Description of Artificial Sequence: Synthetic oligonucleotide
ctgactccgatcggagtcaggg

SEQ ID NO: 6773 - DNA, 22 bp, Artificial Sequence
  Description of Artificial Sequence: Synthetic oligonucleotide
acgactccgatcggagtcgtgg

SEQ ID NO: 6774 - DNA, 22 bp, Artificial Sequence
  Description of Artificial Sequence: Synthetic oligonucleotide
ccgactccgatcggagtcggct

SEQ ID NO: 6775 - DNA, 22 bp, Artificial Sequence
  Description of Artificial Sequence: Synthetic oligonucleotide
ccgactccgatcggagtcggca

SEQ ID NO: 6776 - DNA, 22 bp, Artificial Sequence
  Description of Artificial Sequence: Synthetic oligonucleotide
gagactccgatcggagtctcgc

SEQ ID NO: 6777 - DNA, 22 bp, Artificial Sequence
  Description of Artificial Sequence: Synthetic oligonucleotide
gtgactccgatcggagtcacgc

SEQ ID NO: 6778 - DNA, 22 bp, Artificial Sequence
  Description of Artificial Sequence: Synthetic oligonucleotide
aggactccgatcggagtcctgc

SEQ ID NO: 6779 - DNA, 22 bp, Artificial Sequence
  Description of Artificial Sequence: Synthetic oligonucleotide
tggactccgatcggagtccagc

SEQ ID NO: 6780 - DNA, 22 bp, Artificial Sequence
  Description of Artificial Sequence: Synthetic oligonucleotide
aggactccgatcggagtcctcg

SEQ ID NO: 6781 - DNA, 22 bp, Artificial Sequence
  Description of Artificial Sequence: Synthetic oligonucleotide
tggactccgatcggagtccacg

SEQ ID NO: 6782 - DNA, 22 bp, Artificial Sequence
  Description of Artificial Sequence: Synthetic oligonucleotide
ccgactccgatcggagtcggtg

SEQ ID NO: 6783 - DNA, 22 bp, Artificial Sequence
  Description of Artificial Sequence: Synthetic oligonucleotide
ccgactccgatcggagtcggag

SEQ ID NO: 6784 - DNA, 22 bp, Artificial Sequence
  Description of Artificial Sequence: Synthetic oligonucleotide
gggactccgatcggagtcccgc

SEQ ID NO: 6785 - DNA, 22 bp, Artificial Sequence
  Description of Artificial Sequence: Synthetic oligonucleotide
gggactccgatcggagtccctc

SEQ ID NO: 6786 - DNA, 22 bp, Artificial Sequence
  Description of Artificial Sequence: Synthetic oligonucleotide
gggactccgatcggagtcccac

SEQ ID NO: 6787 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccgtacggagtcnnnn

SEQ ID NO: 6788 - DNA, 22 bp, Artificial Sequence
  Description of Artificial Sequence: Synthetic oligonucleotide
cggactccgtacggagtccgcc

SEQ ID NO: 6789 - DNA, 22 bp, Artificial Sequence
  Description of Artificial Sequence: Synthetic oligonucleotide
cggactccgtacggagtccgct

SEQ ID NO: 6790 - DNA, 22 bp, Artificial Sequence
  Description of Artificial Sequence: Synthetic oligonucleotide
cggactccgtacggagtccgtc

SEQ ID NO: 6791 - DNA, 22 bp, Artificial Sequence
  Description of Artificial Sequence: Synthetic oligonucleotide
aggactccgtacggagtcctcc

SEQ ID NO: 6792 - DNA, 22 bp, Artificial Sequence
  Description of Artificial Sequence: Synthetic oligonucleotide
cagactccgtacggagtctgcc

SEQ ID NO: 6793 - DNA, 22 bp, Artificial Sequence
  Description of Artificial Sequence: Synthetic oligonucleotide
cggactccgtacggagtccgca

SEQ ID NO: 6794 - DNA, 22 bp, Artificial Sequence
  Description of Artificial Sequence: Synthetic oligonucleotide
cggactccgtacggagtccgac

SEQ ID NO: 6795 - DNA, 22 bp, Artificial Sequence
  Description of Artificial Sequence: Synthetic oligonucleotide
tggactccgtacggagtccacc

SEQ ID NO: 6796 - DNA, 22 bp, Artificial Sequence
  Description of Artificial Sequence: Synthetic oligonucleotide
ctgactccgtacggagtcagcc

SEQ ID NO: 6797 - DNA, 22 bp, Artificial Sequence
  Description of Artificial Sequence: Synthetic oligonucleotide
ccgactccgtacggagtcgggc

SEQ ID NO: 6798 - DNA, 22 bp, Artificial Sequence
  Description of Artificial Sequence: Synthetic oligonucleotide
ccgactccgtacggagtcgggt

SEQ ID NO: 6799 - DNA, 22 bp, Artificial Sequence
  Description of Artificial Sequence: Synthetic oligonucleotide
ccgactccgtacggagtcggtc

SEQ ID NO: 6800 - DNA, 22 bp, Artificial Sequence
  Description of Artificial Sequence: Synthetic oligonucleotide
acgactccgtacggagtcgtgc

SEQ ID NO: 6801 - DNA, 22 bp, Artificial Sequence
  Description of Artificial Sequence: Synthetic oligonucleotide
cagactccgtacggagtctggc

SEQ ID NO: 6802 - DNA, 22 bp, Artificial Sequence
  Description of Artificial Sequence: Synthetic oligonucleotide
ccgactccgtacggagtcggga

SEQ ID NO: 6803 - DNA, 22 bp, Artificial Sequence
  Description of Artificial Sequence: Synthetic oligonucleotide
ccgactccgtacggagtcggac

SEQ ID NO: 6804 - DNA, 22 bp, Artificial Sequence
  Description of Artificial Sequence: Synthetic oligonucleotide
ctgactccgtacggagtcaggc

SEQ ID NO: 6805 - DNA, 22 bp, Artificial Sequence
  Description of Artificial Sequence: Synthetic oligonucleotide
gcgactccgtacggagtcgccc

SEQ ID NO: 6806 - DNA, 22 bp, Artificial Sequence
  Description of Artificial Sequence: Synthetic oligonucleotide
gcgactccgtacggagtcgcct

SEQ ID NO: 6807 - DNA, 22 bp, Artificial Sequence
  Description of Artificial Sequence: Synthetic oligonucleotide
gcgactccgtacggagtcgctc

SEQ ID NO: 6808 - DNA, 22 bp, Artificial Sequence
  Description of Artificial Sequence: Synthetic oligonucleotide
acgactccgtacggagtcgtcc

SEQ ID NO: 6809 - DNA, 22 bp, Artificial Sequence
  Description of Artificial Sequence: Synthetic oligonucleotide
gagactccgtacggagtctccc

SEQ ID NO: 6810 - DNA, 22 bp, Artificial Sequence
  Description of Artificial Sequence: Synthetic oligonucleotide
gcgactccgtacggagtcgcca

SEQ ID NO: 6811 - DNA, 22 bp, Artificial Sequence
  Description of Artificial Sequence: Synthetic oligonucleotide
gcgactccgtacggagtcgcac

SEQ ID NO: 6812 - DNA, 22 bp, Artificial Sequence
  Description of Artificial Sequence: Synthetic oligonucleotide
gtgactccgtacggagtcaccc

SEQ ID NO: 6813 - DNA, 22 bp, Artificial Sequence
  Description of Artificial Sequence: Synthetic oligonucleotide
gggactccgtacggagtcccgt

SEQ ID NO: 6814 - DNA, 22 bp, Artificial Sequence
  Description of Artificial Sequence: Synthetic oligonucleotide
gggactccgtacggagtccctg

SEQ ID NO: 6815 - DNA, 22 bp, Artificial Sequence
  Description of Artificial Sequence: Synthetic oligonucleotide
aggactccgtacggagtcctgg

SEQ ID NO: 6816 - DNA, 22 bp, Artificial Sequence
  Description of Artificial Sequence: Synthetic oligonucleotide
gagactccgtacggagtctcgg

SEQ ID NO: 6817 - DNA, 22 bp, Artificial Sequence
  Description of Artificial Sequence: Synthetic oligonucleotide
gggactccgtacggagtcccga

SEQ ID NO: 6818 - DNA, 22 bp, Artificial Sequence
  Description of Artificial Sequence: Synthetic oligonucleotide
gggactccgtacggagtcccag

SEQ ID NO: 6819 - DNA, 22 bp, Artificial Sequence
  Description of Artificial Sequence: Synthetic oligonucleotide
tggactccgtacggagtccagg

SEQ ID NO: 6820 - DNA, 22 bp, Artificial Sequence
  Description of Artificial Sequence: Synthetic oligonucleotide
gtgactccgtacggagtcacgg

SEQ ID NO: 6821 - DNA, 22 bp, Artificial Sequence
  Description of Artificial Sequence: Synthetic oligonucleotide
gcgactccgtacggagtcgccg

SEQ ID NO: 6822 - DNA, 22 bp, Artificial Sequence
  Description of Artificial Sequence: Synthetic oligonucleotide
gcgactccgtacggagtcgctg

SEQ ID NO: 6823 - DNA, 22 bp, Artificial Sequence
  Description of Artificial Sequence: Synthetic oligonucleotide
acgactccgtacggagtcgtcg

SEQ ID NO: 6824 - DNA, 22 bp, Artificial Sequence
  Description of Artificial Sequence: Synthetic oligonucleotide
gagactccgtacggagtctccg

SEQ ID NO: 6825 - DNA, 22 bp, Artificial Sequence
  Description of Artificial Sequence: Synthetic oligonucleotide
gcgactccgtacggagtcgcag

SEQ ID NO: 6826 - DNA, 22 bp, Artificial Sequence
  Description of Artificial Sequence: Synthetic oligonucleotide
gtgactccgtacggagtcaccg

SEQ ID NO: 6827 - DNA, 22 bp, Artificial Sequence
  Description of Artificial Sequence: Synthetic oligonucleotide
cggactccgtacggagtccgtg

SEQ ID NO: 6828 - DNA, 22 bp, Artificial Sequence
  Description of Artificial Sequence: Synthetic oligonucleotide
cagactccgtacggagtctggg

SEQ ID NO: 6829 - DNA, 22 bp, Artificial Sequence
  Description of Artificial Sequence: Synthetic oligonucleotide
cggactccgtacggagtccgag

SEQ ID NO: 6830 - DNA, 22 bp, Artificial Sequence
  Description of Artificial Sequence: Synthetic oligonucleotide
ctgactccgtacggagtcaggg

SEQ ID NO: 6831 - DNA, 22 bp, Artificial Sequence
  Description of Artificial Sequence: Synthetic oligonucleotide
acgactccgtacggagtcgtgg

SEQ ID NO: 6832 - DNA, 22 bp, Artificial Sequence
  Description of Artificial Sequence: Synthetic oligonucleotide
ccgactccgtacggagtcggct

SEQ ID NO: 6833 - DNA, 22 bp, Artificial Sequence
  Description of Artificial Sequence: Synthetic oligonucleotide
ccgactccgtacggagtcggca

SEQ ID NO: 6834 - DNA, 22 bp, Artificial Sequence
  Description of Artificial Sequence: Synthetic oligonucleotide
gagactccgtacggagtctcgc

SEQ ID NO: 6835 - DNA, 22 bp, Artificial Sequence
  Description of Artificial Sequence: Synthetic oligonucleotide
gtgactccgtacggagtcacgc

SEQ ID NO: 6836 - DNA, 22 bp, Artificial Sequence
  Description of Artificial Sequence: Synthetic oligonucleotide
aggactccgtacggagtcctgc

SEQ ID NO: 6837 - DNA, 22 bp, Artificial Sequence
  Description of Artificial Sequence: Synthetic oligonucleotide
tggactccgtacggagtccagc

SEQ ID NO: 6838 - DNA, 22 bp, Artificial Sequence
  Description of Artificial Sequence: Synthetic oligonucleotide
aggactccgtacggagtcctcg

SEQ ID NO: 6839 - DNA, 22 bp, Artificial Sequence
  Description of Artificial Sequence: Synthetic oligonucleotide
tggactccgtacggagtccacg

SEQ ID NO: 6840 - DNA, 22 bp, Artificial Sequence
  Description of Artificial Sequence: Synthetic oligonucleotide
ccgactccgtacggagtcggtg

SEQ ID NO: 6841 - DNA, 22 bp, Artificial Sequence
  Description of Artificial Sequence: Synthetic oligonucleotide
ccgactccgtacggagtcggag

SEQ ID NO: 6842 - DNA, 22 bp, Artificial Sequence
  Description of Artificial Sequence: Synthetic oligonucleotide
gggactccgtacggagtcccgc

SEQ ID NO: 6843 - DNA, 22 bp, Artificial Sequence
  Description of Artificial Sequence: Synthetic oligonucleotide
gggactccgtacggagtccctc

SEQ ID NO: 6844 - DNA, 22 bp, Artificial Sequence
  Description of Artificial Sequence: Synthetic oligonucleotide
gggactccgtacggagtcccac

SEQ ID NO: 6845 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccggccggagtcnnnn

SEQ ID NO: 6846 - DNA, 22 bp, Artificial Sequence
  Description of Artificial Sequence: Synthetic oligonucleotide
cggactccggccggagtccgcc

SEQ ID NO: 6847 - DNA, 22 bp, Artificial Sequence
  Description of Artificial Sequence: Synthetic oligonucleotide
cggactccggccggagtccgct

SEQ ID NO: 6848 - DNA, 22 bp, Artificial Sequence
  Description of Artificial Sequence: Synthetic oligonucleotide
cggactccggccggagtccgtc

SEQ ID NO: 6849 - DNA, 22 bp, Artificial Sequence
  Description of Artificial Sequence: Synthetic oligonucleotide
aggactccggccggagtcctcc

SEQ ID NO: 6850 - DNA, 22 bp, Artificial Sequence
  Description of Artificial Sequence: Synthetic oligonucleotide
cagactccggccggagtctgcc

SEQ ID NO: 6851 - DNA, 22 bp, Artificial Sequence
  Description of Artificial Sequence: Synthetic oligonucleotide
cggactccggccggagtccgca

SEQ ID NO: 6852 - DNA, 22 bp, Artificial Sequence
  Description of Artificial Sequence: Synthetic oligonucleotide
cggactccggccggagtccgac

SEQ ID NO: 6853 - DNA, 22 bp, Artificial Sequence
  Description of Artificial Sequence: Synthetic oligonucleotide
tggactccggccggagtccacc

SEQ ID NO: 6854 - DNA, 22 bp, Artificial Sequence
  Description of Artificial Sequence: Synthetic oligonucleotide
ctgactccggccggagtcagcc

SEQ ID NO: 6855 - DNA, 22 bp, Artificial Sequence
  Description of Artificial Sequence: Synthetic oligonucleotide
ccgactccggccggagtcgggc

SEQ ID NO: 6856 - DNA, 22 bp, Artificial Sequence
  Description of Artificial Sequence: Synthetic oligonucleotide
ccgactccggccggagtcgggt

SEQ ID NO: 6857 - DNA, 22 bp, Artificial Sequence
  Description of Artificial Sequence: Synthetic oligonucleotide
ccgactccggccggagtcggtc

SEQ ID NO: 6858 - DNA, 22 bp, Artificial Sequence
  Description of Artificial Sequence: Synthetic oligonucleotide
acgactccggccggagtcgtgc

SEQ ID NO: 6859 - DNA, 22 bp, Artificial Sequence
  Description of Artificial Sequence: Synthetic oligonucleotide
cagactccggccggagtctggc

SEQ ID NO: 6860 - DNA, 22 bp, Artificial Sequence
  Description of Artificial Sequence: Synthetic oligonucleotide
ccgactccggccggagtcggga

SEQ ID NO: 6861 - DNA, 22 bp, Artificial Sequence
  Description of Artificial Sequence: Synthetic oligonucleotide
ccgactccggccggagtcggac

SEQ ID NO: 6862 - DNA, 22 bp, Artificial Sequence
  Description of Artificial Sequence: Synthetic oligonucleotide
ctgactccggccggagtcaggc

SEQ ID NO: 6863 - DNA, 22 bp, Artificial Sequence
  Description of Artificial Sequence: Synthetic oligonucleotide
gcgactccggccggagtcgccc

SEQ ID NO: 6864 - DNA, 22 bp, Artificial Sequence
  Description of Artificial Sequence: Synthetic oligonucleotide
gcgactccggccggagtcgcct

SEQ ID NO: 6865 - DNA, 22 bp, Artificial Sequence
  Description of Artificial Sequence: Synthetic oligonucleotide
gcgactccggccggagtcgctc

SEQ ID NO: 6866 - DNA, 22 bp, Artificial Sequence
  Description of Artificial Sequence: Synthetic oligonucleotide
acgactccggccggagtcgtcc

SEQ ID NO: 6867 - DNA, 22 bp, Artificial Sequence
  Description of Artificial Sequence: Synthetic oligonucleotide
gagactccggccggagtctccc

SEQ ID NO: 6868 - DNA, 22 bp, Artificial Sequence
  Description of Artificial Sequence: Synthetic oligonucleotide
gcgactccggccggagtcgcca

SEQ ID NO: 6869 - DNA, 22 bp, Artificial Sequence
  Description of Artificial Sequence: Synthetic oligonucleotide
gcgactccggccggagtcgcac

SEQ ID NO: 6870 - DNA, 22 bp, Artificial Sequence
  Description of Artificial Sequence: Synthetic oligonucleotide
gtgactccggccggagtcaccc

SEQ ID NO: 6871 - DNA, 22 bp, Artificial Sequence
  Description of Artificial Sequence: Synthetic oligonucleotide
gggactccggccggagtcccgt

SEQ ID NO: 6872 - DNA, 22 bp, Artificial Sequence
  Description of Artificial Sequence: Synthetic oligonucleotide
gggactccggccggagtccctg

SEQ ID NO: 6873 - DNA, 22 bp, Artificial Sequence
  Description of Artificial Sequence: Synthetic oligonucleotide
aggactccggccggagtcctgg

SEQ ID NO: 6874 - DNA, 22 bp, Artificial Sequence
  Description of Artificial Sequence: Synthetic oligonucleotide
gagactccggccggagtctcgg

SEQ ID NO: 6875 - DNA, 22 bp, Artificial Sequence
  Description of Artificial Sequence: Synthetic oligonucleotide
gggactccggccggagtcccga

SEQ ID NO: 6876 - DNA, 22 bp, Artificial Sequence
  Description of Artificial Sequence: Synthetic oligonucleotide
gggactccggccggagtcccag

SEQ ID NO: 6877 - DNA, 22 bp, Artificial Sequence
  Description of Artificial Sequence: Synthetic oligonucleotide
tggactccggccggagtccagg

SEQ ID NO: 6878 - DNA, 22 bp, Artificial Sequence
  Description of Artificial Sequence: Synthetic oligonucleotide
gtgactccggccggagtcacgg

SEQ ID NO: 6879 - DNA, 22 bp, Artificial Sequence
  Description of Artificial Sequence: Synthetic oligonucleotide
gcgactccggccggagtcgccg

SEQ ID NO: 6880 - DNA, 22 bp, Artificial Sequence
  Description of Artificial Sequence: Synthetic oligonucleotide
gcgactccggccggagtcgctg

SEQ ID NO: 6881 - DNA, 22 bp, Artificial Sequence
  Description of Artificial Sequence: Synthetic oligonucleotide
acgactccggccggagtcgtcg

SEQ ID NO: 6882 - DNA, 22 bp, Artificial Sequence
  Description of Artificial Sequence: Synthetic oligonucleotide
gagactccggccggagtctccg

SEQ ID NO: 6883 - DNA, 22 bp, Artificial Sequence
  Description of Artificial Sequence: Synthetic oligonucleotide
gcgactccggccggagtcgcag

SEQ ID NO: 6884 - DNA, 22 bp, Artificial Sequence
  Description of Artificial Sequence: Synthetic oligonucleotide
gtgactccggccggagtcaccg

SEQ ID NO: 6885 - DNA, 22 bp, Artificial Sequence
  Description of Artificial Sequence: Synthetic oligonucleotide
cggactccggccggagtccgtg

SEQ ID NO: 6886 - DNA, 22 bp, Artificial Sequence
  Description of Artificial Sequence: Synthetic oligonucleotide
cagactccggccggagtctggg

SEQ ID NO: 6887 - DNA, 22 bp, Artificial Sequence
  Description of Artificial Sequence: Synthetic oligonucleotide
cggactccggccggagtccgag

SEQ ID NO: 6888 - DNA, 22 bp, Artificial Sequence
  Description of Artificial Sequence: Synthetic oligonucleotide
ctgactccggccggagtcaggg

SEQ ID NO: 6889 - DNA, 22 bp, Artificial Sequence
  Description of Artificial Sequence: Synthetic oligonucleotide
acgactccggccggagtcgtgg

SEQ ID NO: 6890 - DNA, 22 bp, Artificial Sequence
  Description of Artificial Sequence: Synthetic oligonucleotide
ccgactccggccggagtcggct

SEQ ID NO: 6891 - DNA, 22 bp, Artificial Sequence
  Description of Artificial Sequence: Synthetic oligonucleotide
ccgactccggccggagtcggca

SEQ ID NO: 6892 - DNA, 22 bp, Artificial Sequence
  Description of Artificial Sequence: Synthetic oligonucleotide
gagactccggccggagtctcgc

SEQ ID NO: 6893 - DNA, 22 bp, Artificial Sequence
  Description of Artificial Sequence: Synthetic oligonucleotide
gtgactccggccggagtcacgc

SEQ ID NO: 6894 - DNA, 22 bp, Artificial Sequence
  Description of Artificial Sequence: Synthetic oligonucleotide
aggactccggccggagtcctgc

SEQ ID NO: 6895 - DNA, 22 bp, Artificial Sequence
  Description of Artificial Sequence: Synthetic oligonucleotide
tggactccggccggagtccagc

SEQ ID NO: 6896 - DNA, 22 bp, Artificial Sequence
  Description of Artificial Sequence: Synthetic oligonucleotide
aggactccggccggagtcctcg

SEQ ID NO: 6897 - DNA, 22 bp, Artificial Sequence
  Description of Artificial Sequence: Synthetic oligonucleotide
tggactccggccggagtccacg

SEQ ID NO: 6898 - DNA, 22 bp, Artificial Sequence
  Description of Artificial Sequence: Synthetic oligonucleotide
ccgactccggccggagtcggtg

SEQ ID NO: 6899 - DNA, 22 bp, Artificial Sequence
  Description of Artificial Sequence: Synthetic oligonucleotide
ccgactccggccggagtcggag

SEQ ID NO: 6900 - DNA, 22 bp, Artificial Sequence
  Description of Artificial Sequence: Synthetic oligonucleotide
gggactccggccggagtcccgc

SEQ ID NO: 6901 - DNA, 22 bp, Artificial Sequence
  Description of Artificial Sequence: Synthetic oligonucleotide
gggactccggccggagtccctc

SEQ ID NO: 6902 - DNA, 22 bp, Artificial Sequence
  Description of Artificial Sequence: Synthetic oligonucleotide
gggactccggccggagtcccac

SEQ ID NO: 6903 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccgcgcggagtcnnnn

SEQ ID NO: 6904 - DNA, 22 bp, Artificial Sequence
  Description of Artificial Sequence: Synthetic oligonucleotide
cggactccgcgcggagtccgcc

SEQ ID NO: 6905 - DNA, 22 bp, Artificial Sequence
  Description of Artificial Sequence: Synthetic oligonucleotide
cggactccgcgcggagtccgct

SEQ ID NO: 6906 - DNA, 22 bp, Artificial Sequence
  Description of Artificial Sequence: Synthetic oligonucleotide
cggactccgcgcggagtccgtc

SEQ ID NO: 6907 - DNA, 22 bp, Artificial Sequence
  Description of Artificial Sequence: Synthetic oligonucleotide
aggactccgcgcggagtcctcc

SEQ ID NO: 6908 - DNA, 22 bp, Artificial Sequence
  Description of Artificial Sequence: Synthetic oligonucleotide
cagactccgcgcggagtctgcc

SEQ ID NO: 6909 - DNA, 22 bp, Artificial Sequence
  Description of Artificial Sequence: Synthetic oligonucleotide
cggactccgcgcggagtccgca

SEQ ID NO: 6910 - DNA, 22 bp, Artificial Sequence
  Description of Artificial Sequence: Synthetic oligonucleotide
cggactccgcgcggagtccgac

SEQ ID NO: 6911 - DNA, 22 bp, Artificial Sequence
  Description of Artificial Sequence: Synthetic oligonucleotide
tggactccgcgcggagtccacc

SEQ ID NO: 6912 - DNA, 22 bp, Artificial Sequence
  Description of Artificial Sequence: Synthetic oligonucleotide
ctgactccgcgcggagtcagcc

SEQ ID NO: 6913 - DNA, 22 bp, Artificial Sequence
  Description of Artificial Sequence: Synthetic oligonucleotide
ccgactccgcgcggagtcgggc

SEQ ID NO: 6914 - DNA, 22 bp, Artificial Sequence
  Description of Artificial Sequence: Synthetic oligonucleotide
ccgactccgcgcggagtcgggt

SEQ ID NO: 6915 - DNA, 22 bp, Artificial Sequence
  Description of Artificial Sequence: Synthetic oligonucleotide
ccgactccgcgcggagtcggtc

SEQ ID NO: 6916 - DNA, 22 bp, Artificial Sequence
  Description of Artificial Sequence: Synthetic oligonucleotide
acgactccgcgcggagtcgtgc

SEQ ID NO: 6917 - DNA, 22 bp, Artificial Sequence
  Description of Artificial Sequence: Synthetic oligonucleotide
cagactccgcgcggagtctggc

SEQ ID NO: 6918 - DNA, 22 bp, Artificial Sequence
  Description of Artificial Sequence: Synthetic oligonucleotide
ccgactccgcgcggagtcggga

SEQ ID NO: 6919 - DNA, 22 bp, Artificial Sequence
  Description of Artificial Sequence: Synthetic oligonucleotide
ccgactccgcgcggagtcggac

SEQ ID NO: 6920 - DNA, 22 bp, Artificial Sequence
  Description of Artificial Sequence: Synthetic oligonucleotide
ctgactccgcgcggagtcaggc

SEQ ID NO: 6921 - DNA, 22 bp, Artificial Sequence
  Description of Artificial Sequence: Synthetic oligonucleotide
gcgactccgcgcggagtcgccc

SEQ ID NO: 6922 - DNA, 22 bp, Artificial Sequence
  Description of Artificial Sequence: Synthetic oligonucleotide
gcgactccgcgcggagtcgcct

SEQ ID NO: 6923 - DNA, 22 bp, Artificial Sequence
  Description of Artificial Sequence: Synthetic oligonucleotide
gcgactccgcgcggagtcgctc

SEQ ID NO: 6924 - DNA, 22 bp, Artificial Sequence
  Description of Artificial Sequence: Synthetic oligonucleotide
acgactccgcgcggagtcgtcc

SEQ ID NO: 6925 - DNA, 22 bp, Artificial Sequence
  Description of Artificial Sequence: Synthetic oligonucleotide
gagactccgcgcggagtctccc

SEQ ID NO: 6926 - DNA, 22 bp, Artificial Sequence
  Description of Artificial Sequence: Synthetic oligonucleotide
gcgactccgcgcggagtcgcca

SEQ ID NO: 6927 - DNA, 22 bp, Artificial Sequence
  Description of Artificial Sequence: Synthetic oligonucleotide
gcgactccgcgcggagtcgcac

SEQ ID NO: 6928 - DNA, 22 bp, Artificial Sequence
  Description of Artificial Sequence: Synthetic oligonucleotide
gtgactccgcgcggagtcaccc

SEQ ID NO: 6929 - DNA, 22 bp, Artificial Sequence
  Description of Artificial Sequence: Synthetic oligonucleotide
gggactccgcgcggagtcccgt

SEQ ID NO: 6930 - DNA, 22 bp, Artificial Sequence
  Description of Artificial Sequence: Synthetic oligonucleotide
gggactccgcgcggagtccctg

SEQ ID NO: 6931 - DNA, 22 bp, Artificial Sequence
  Description of Artificial Sequence: Synthetic oligonucleotide
aggactccgcgcggagtcctgg

SEQ ID NO: 6932 - DNA, 22 bp, Artificial Sequence
  Description of Artificial Sequence: Synthetic oligonucleotide
gagactccgcgcggagtctcgg

SEQ ID NO: 6933 - DNA, 22 bp, Artificial Sequence
  Description of Artificial Sequence: Synthetic oligonucleotide
gggactccgcgcggagtcccga

SEQ ID NO: 6934 - DNA, 22 bp, Artificial Sequence
  Description of Artificial Sequence: Synthetic oligonucleotide
gggactccgcgcggagtcccag

SEQ ID NO: 6935 - DNA, 22 bp, Artificial Sequence
  Description of Artificial Sequence: Synthetic oligonucleotide
tggactccgcgcggagtccagg

SEQ ID NO: 6936 - DNA, 22 bp, Artificial Sequence
  Description of Artificial Sequence: Synthetic oligonucleotide
gtgactccgcgcggagtcacgg

SEQ ID NO: 6937 - DNA, 22 bp, Artificial Sequence
  Description of Artificial Sequence: Synthetic oligonucleotide
gcgactccgcgcggagtcgccg

SEQ ID NO: 6938 - DNA, 22 bp, Artificial Sequence
  Description of Artificial Sequence: Synthetic oligonucleotide
gcgactccgcgcggagtcgctg

SEQ ID NO: 6939 - DNA, 22 bp, Artificial Sequence
  Description of Artificial Sequence: Synthetic oligonucleotide
acgactccgcgcggagtcgtcg

SEQ ID NO: 6940 - DNA, 22 bp, Artificial Sequence
  Description of Artificial Sequence: Synthetic oligonucleotide
gagactccgcgcggagtctccg

SEQ ID NO: 6941 - DNA, 22 bp, Artificial Sequence
  Description of Artificial Sequence: Synthetic oligonucleotide
gcgactccgcgcggagtcgcag

SEQ ID NO: 6942 - DNA, 22 bp, Artificial Sequence
  Description of Artificial Sequence: Synthetic oligonucleotide
gtgactccgcgcggagtcaccg

SEQ ID NO: 6943 - DNA, 22 bp, Artificial Sequence
  Description of Artificial Sequence: Synthetic oligonucleotide
cggactccgcgcggagtccgtg

SEQ ID NO: 6944 - DNA, 22 bp, Artificial Sequence
  Description of Artificial Sequence: Synthetic oligonucleotide
cagactccgcgcggagtctggg

SEQ ID NO: 6945 - DNA, 22 bp, Artificial Sequence
  Description of Artificial Sequence: Synthetic oligonucleotide
cggactccgcgcggagtccgag

SEQ ID NO: 6946 - DNA, 22 bp, Artificial Sequence
  Description of Artificial Sequence: Synthetic oligonucleotide
ctgactccgcgcggagtcaggg

SEQ ID NO: 6947 - DNA, 22 bp, Artificial Sequence
  Description of Artificial Sequence: Synthetic oligonucleotide
acgactccgcgcggagtcgtgg

SEQ ID NO: 6948 - DNA, 22 bp, Artificial Sequence
  Description of Artificial Sequence: Synthetic oligonucleotide
ccgactccgcgcggagtcggct

SEQ ID NO: 6949 - DNA, 22 bp, Artificial Sequence
  Description of Artificial Sequence: Synthetic oligonucleotide
ccgactccgcgcggagtcggca

SEQ ID NO: 6950 - DNA, 22 bp, Artificial Sequence
  Description of Artificial Sequence: Synthetic oligonucleotide
gagactccgcgcggagtctcgc

SEQ ID NO: 6951 - DNA, 22 bp, Artificial Sequence
  Description of Artificial Sequence: Synthetic oligonucleotide
gtgactccgcgcggagtcacgc

SEQ ID NO: 6952 - DNA, 22 bp, Artificial Sequence
  Description of Artificial Sequence: Synthetic oligonucleotide
aggactccgcgcggagtcctgc

SEQ ID NO: 6953 - DNA, 22 bp, Artificial Sequence
  Description of Artificial Sequence: Synthetic oligonucleotide
tggactccgcgcggagtccagc

SEQ ID NO: 6954 - DNA, 22 bp, Artificial Sequence
  Description of Artificial Sequence: Synthetic oligonucleotide
aggactccgcgcggagtcctcg

SEQ ID NO: 6955 - DNA, 22 bp, Artificial Sequence
  Description of Artificial Sequence: Synthetic oligonucleotide
tggactccgcgcggagtccacg

SEQ ID NO: 6956 - DNA, 22 bp, Artificial Sequence
  Description of Artificial Sequence: Synthetic oligonucleotide
ccgactccgcgcggagtcggtg

SEQ ID NO: 6957 - DNA, 22 bp, Artificial Sequence
  Description of Artificial Sequence: Synthetic oligonucleotide
ccgactccgcgcggagtcggag

SEQ ID NO: 6958 - DNA, 22 bp, Artificial Sequence
  Description of Artificial Sequence: Synthetic oligonucleotide
gggactccgcgcggagtcccgc

SEQ ID NO: 6959 - DNA, 22 bp, Artificial Sequence
  Description of Artificial Sequence: Synthetic oligonucleotide
gggactccgcgcggagtccctc

SEQ ID NO: 6960 - DNA, 22 bp, Artificial Sequence
  Description of Artificial Sequence: Synthetic oligonucleotide
gggactccgcgcggagtcccac

SEQ ID NO: 6961 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctgatcagagtcnnnn

SEQ ID NO: 6962 - DNA, 22 bp, Artificial Sequence
  Description of Artificial Sequence: Synthetic oligonucleotide
cggactctgatcagagtccgcc

SEQ ID NO: 6963 - DNA, 22 bp, Artificial Sequence
  Description of Artificial Sequence: Synthetic oligonucleotide
cggactctgatcagagtccgct

SEQ ID NO: 6964 - DNA, 22 bp, Artificial Sequence
  Description of Artificial Sequence: Synthetic oligonucleotide
cggactctgatcagagtccgtc

SEQ ID NO: 6965 - DNA, 22 bp, Artificial Sequence
  Description of Artificial Sequence: Synthetic oligonucleotide
aggactctgatcagagtcctcc

SEQ ID NO: 6966 - DNA, 22 bp, Artificial Sequence
  Description of Artificial Sequence: Synthetic oligonucleotide
cagactctgatcagagtctgcc

SEQ ID NO: 6967 - DNA, 22 bp, Artificial Sequence
  Description of Artificial Sequence: Synthetic oligonucleotide
cggactctgatcagagtccgca

SEQ ID NO: 6968 - DNA, 22 bp, Artificial Sequence
  Description of Artificial Sequence: Synthetic oligonucleotide
cggactctgatcagagtccgac

SEQ ID NO: 6969 - DNA, 22 bp, Artificial Sequence
  Description of Artificial Sequence: Synthetic oligonucleotide
tggactctgatcagagtccacc

SEQ ID NO: 6970 - DNA, 22 bp, Artificial Sequence
  Description of Artificial Sequence: Synthetic oligonucleotide
ctgactctgatcagagtcagcc

SEQ ID NO: 6971 - DNA, 22 bp, Artificial Sequence
  Description of Artificial Sequence: Synthetic oligonucleotide
ccgactctgatcagagtcgggc

SEQ ID NO: 6972 - DNA, 22 bp, Artificial Sequence
  Description of Artificial Sequence: Synthetic oligonucleotide
ccgactctgatcagagtcgggt

SEQ ID NO: 6973 - DNA, 22 bp, Artificial Sequence
  Description of Artificial Sequence: Synthetic oligonucleotide
ccgactctgatcagagtcggtc

SEQ ID NO: 6974 - DNA, 22 bp, Artificial Sequence
  Description of Artificial Sequence: Synthetic oligonucleotide
acgactctgatcagagtcgtgc

SEQ ID NO: 6975 - DNA, 22 bp, Artificial Sequence
  Description of Artificial Sequence: Synthetic oligonucleotide
cagactctgatcagagtctggc

SEQ ID NO: 6976 - DNA, 22 bp, Artificial Sequence
  Description of Artificial Sequence: Synthetic oligonucleotide
ccgactctgatcagagtcggga

SEQ ID NO: 6977 - DNA, 22 bp, Artificial Sequence
  Description of Artificial Sequence: Synthetic oligonucleotide
ccgactctgatcagagtcggac

SEQ ID NO: 6978 - DNA, 22 bp, Artificial Sequence
  Description of Artificial Sequence: Synthetic oligonucleotide
ctgactctgatcagagtcaggc

SEQ ID NO: 6979 - DNA, 22 bp, Artificial Sequence
  Description of Artificial Sequence: Synthetic oligonucleotide
gcgactctgatcagagtcgccc

SEQ ID NO: 6980 - DNA, 22 bp, Artificial Sequence
  Description of Artificial Sequence: Synthetic oligonucleotide
gcgactctgatcagagtcgcct

SEQ ID NO: 6981 - DNA, 22 bp, Artificial Sequence
  Description of Artificial Sequence: Synthetic oligonucleotide
gcgactctgatcagagtcgctc

SEQ ID NO: 6982 - DNA, 22 bp, Artificial Sequence
  Description of Artificial Sequence: Synthetic oligonucleotide
acgactctgatcagagtcgtcc

SEQ ID NO: 6983 - DNA, 22 bp, Artificial Sequence
  Description of Artificial Sequence: Synthetic oligonucleotide
gagactctgatcagagtctccc

SEQ ID NO: 6984 - DNA, 22 bp, Artificial Sequence
  Description of Artificial Sequence: Synthetic oligonucleotide
gcgactctgatcagagtcgcca

SEQ ID NO: 6985 - DNA, 22 bp, Artificial Sequence
  Description of Artificial Sequence: Synthetic oligonucleotide
gcgactctgatcagagtcgcac

SEQ ID NO: 6986 - DNA, 22 bp, Artificial Sequence
  Description of Artificial Sequence: Synthetic oligonucleotide
gtgactctgatcagagtcaccc

SEQ ID NO: 6987 - DNA, 22 bp, Artificial Sequence
  Description of Artificial Sequence: Synthetic oligonucleotide
gggactctgatcagagtcccgt

SEQ ID NO: 6988 - DNA, 22 bp, Artificial Sequence
  Description of Artificial Sequence: Synthetic oligonucleotide
gggactctgatcagagtccctg

SEQ ID NO: 6989 - DNA, 22 bp, Artificial Sequence
  Description of Artificial Sequence: Synthetic oligonucleotide
aggactctgatcagagtcctgg

SEQ ID NO: 6990 - DNA, 22 bp, Artificial Sequence
  Description of Artificial Sequence: Synthetic oligonucleotide
gagactctgatcagagtctcgg

SEQ ID NO: 6991 - DNA, 22 bp, Artificial Sequence
  Description of Artificial Sequence: Synthetic oligonucleotide
gggactctgatcagagtcccga

SEQ ID NO: 6992 - DNA, 22 bp, Artificial Sequence
  Description of Artificial Sequence: Synthetic oligonucleotide
gggactctgatcagagtcccag

SEQ ID NO: 6993 - DNA, 22 bp, Artificial Sequence
  Description of Artificial Sequence: Synthetic oligonucleotide
tggactctgatcagagtccagg

SEQ ID NO: 6994 - DNA, 22 bp, Artificial Sequence
  Description of Artificial Sequence: Synthetic oligonucleotide
gtgactctgatcagagtcacgg

SEQ ID NO: 6995 - DNA, 22 bp, Artificial Sequence
  Description of Artificial Sequence: Synthetic oligonucleotide
gcgactctgatcagagtcgccg

SEQ ID NO: 6996 - DNA, 22 bp, Artificial Sequence
  Description of Artificial Sequence: Synthetic oligonucleotide
gcgactctgatcagagtcgctg

SEQ ID NO: 6997 - DNA, 22 bp, Artificial Sequence
  Description of Artificial Sequence: Synthetic oligonucleotide
acgactctgatcagagtcgtcg

SEQ ID NO: 6998 - DNA, 22 bp, Artificial Sequence
  Description of Artificial Sequence: Synthetic oligonucleotide
gagactctgatcagagtctccg

SEQ ID NO: 6999 - DNA, 22 bp, Artificial Sequence
  Description of Artificial Sequence: Synthetic oligonucleotide
gcgactctgatcagagtcgcag

SEQ ID NO: 7000 - DNA, 22 bp, Artificial Sequence
  Description of Artificial Sequence: Synthetic oligonucleotide
gtgactctgatcagagtcaccg

SEQ ID NO: 7001 - DNA, 22 bp, Artificial Sequence
  Description of Artificial Sequence: Synthetic oligonucleotide
cggactctgatcagagtccgtg

SEQ ID NO: 7002 - DNA, 22 bp, Artificial Sequence
  Description of Artificial Sequence: Synthetic oligonucleotide
cagactctgatcagagtctggg

SEQ ID NO: 7003 - DNA, 22 bp, Artificial Sequence
  Description of Artificial Sequence: Synthetic oligonucleotide
cggactctgatcagagtccgag

SEQ ID NO: 7004 - DNA, 22 bp, Artificial Sequence
  Description of Artificial Sequence: Synthetic oligonucleotide
ctgactctgatcagagtcaggg

SEQ ID NO: 7005 - DNA, 22 bp, Artificial Sequence
  Description of Artificial Sequence: Synthetic oligonucleotide
acgactctgatcagagtcgtgg

SEQ ID NO: 7006 - DNA, 22 bp, Artificial Sequence
  Description of Artificial Sequence: Synthetic oligonucleotide
ccgactctgatcagagtcggct

SEQ ID NO: 7007 - DNA, 22 bp, Artificial Sequence
  Description of Artificial Sequence: Synthetic oligonucleotide
ccgactctgatcagagtcggca

SEQ ID NO: 7008 - DNA, 22 bp, Artificial Sequence
  Description of Artificial Sequence: Synthetic oligonucleotide
gagactctgatcagagtctcgc

SEQ ID NO: 7009 - DNA, 22 bp, Artificial Sequence
  Description of Artificial Sequence: Synthetic oligonucleotide
gtgactctgatcagagtcacgc

SEQ ID NO: 7010 - DNA, 22 bp, Artificial Sequence
  Description of Artificial Sequence: Synthetic oligonucleotide
aggactctgatcagagtcctgc

SEQ ID NO: 7011 - DNA, 22 bp, Artificial Sequence
  Description of Artificial Sequence: Synthetic oligonucleotide
tggactctgatcagagtccagc

SEQ ID NO: 7012 - DNA, 22 bp, Artificial Sequence
  Description of Artificial Sequence: Synthetic oligonucleotide
aggactctgatcagagtcctcg

SEQ ID NO: 7013 - DNA, 22 bp, Artificial Sequence
  Description of Artificial Sequence: Synthetic oligonucleotide
tggactctgatcagagtccacg

SEQ ID NO: 7014 - DNA, 22 bp, Artificial Sequence
  Description of Artificial Sequence: Synthetic oligonucleotide
ccgactctgatcagagtcggtg

SEQ ID NO: 7015 - DNA, 22 bp, Artificial Sequence
  Description of Artificial Sequence: Synthetic oligonucleotide
ccgactctgatcagagtcggag

SEQ ID NO: 7016 - DNA, 22 bp, Artificial Sequence
  Description of Artificial Sequence: Synthetic oligonucleotide
gggactctgatcagagtcccgc

SEQ ID NO: 7017 - DNA, 22 bp, Artificial Sequence
  Description of Artificial Sequence: Synthetic oligonucleotide
gggactctgatcagagtccctc

SEQ ID NO: 7018 - DNA, 22 bp, Artificial Sequence
  Description of Artificial Sequence: Synthetic oligonucleotide
gggactctgatcagagtcccac

SEQ ID NO: 7019 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctgtacagagtcnnnn

SEQ ID NO: 7020 - DNA, 22 bp, Artificial Sequence
  Description of Artificial Sequence: Synthetic oligonucleotide
cggactctgtacagagtccgcc

SEQ ID NO: 7021 - DNA, 22 bp, Artificial Sequence
  Description of Artificial Sequence: Synthetic oligonucleotide
cggactctgtacagagtccgct

SEQ ID NO: 7022 - DNA, 22 bp, Artificial Sequence
  Description of Artificial Sequence: Synthetic oligonucleotide
cggactctgtacagagtccgtc

SEQ ID NO: 7023 - DNA, 22 bp, Artificial Sequence
  Description of Artificial Sequence: Synthetic oligonucleotide
aggactctgtacagagtcctcc

SEQ ID NO: 7024 - DNA, 22 bp, Artificial Sequence
  Description of Artificial Sequence: Synthetic oligonucleotide
cagactctgtacagagtctgcc

SEQ ID NO: 7025 - DNA, 22 bp, Artificial Sequence
  Description of Artificial Sequence: Synthetic oligonucleotide
cggactctgtacagagtccgca

SEQ ID NO: 7026 - DNA, 22 bp, Artificial Sequence
  Description of Artificial Sequence: Synthetic oligonucleotide
cggactctgtacagagtccgac

SEQ ID NO: 7027 - DNA, 22 bp, Artificial Sequence
  Description of Artificial Sequence: Synthetic oligonucleotide
tggactctgtacagagtccacc

SEQ ID NO: 7028 - DNA, 22 bp, Artificial Sequence
  Description of Artificial Sequence: Synthetic oligonucleotide
ctgactctgtacagagtcagcc

SEQ ID NO: 7029 - DNA, 22 bp, Artificial Sequence
  Description of Artificial Sequence: Synthetic oligonucleotide
ccgactctgtacagagtcgggc

SEQ ID NO: 7030 - DNA, 22 bp, Artificial Sequence
  Description of Artificial Sequence: Synthetic oligonucleotide
ccgactctgtacagagtcgggt

SEQ ID NO: 7031 - DNA, 22 bp, Artificial Sequence
  Description of Artificial Sequence: Synthetic oligonucleotide
ccgactctgtacagagtcggtc

SEQ ID NO: 7032 - DNA, 22 bp, Artificial Sequence
  Description of Artificial Sequence: Synthetic oligonucleotide
acgactctgtacagagtcgtgc

SEQ ID NO: 7033 - DNA, 22 bp, Artificial Sequence
  Description of Artificial Sequence: Synthetic oligonucleotide
cagactctgtacagagtctggc

SEQ ID NO: 7034 - DNA, 22 bp, Artificial Sequence
  Description of Artificial Sequence: Synthetic oligonucleotide
ccgactctgtacagagtcggga

SEQ ID NO: 7035 - DNA, 22 bp, Artificial Sequence
  Description of Artificial Sequence: Synthetic oligonucleotide
ccgactctgtacagagtcggac

SEQ ID NO: 7036 - DNA, 22 bp, Artificial Sequence
  Description of Artificial Sequence: Synthetic oligonucleotide
ctgactctgtacagagtcaggc

SEQ ID NO: 7037 - DNA, 22 bp, Artificial Sequence
  Description of Artificial Sequence: Synthetic oligonucleotide
gcgactctgtacagagtcgccc

SEQ ID NO: 7038 - DNA, 22 bp, Artificial Sequence
  Description of Artificial Sequence: Synthetic oligonucleotide
gcgactctgtacagagtcgcct

SEQ ID NO: 7039 - DNA, 22 bp, Artificial Sequence
  Description of Artificial Sequence: Synthetic oligonucleotide
gcgactctgtacagagtcgctc

SEQ ID NO: 7040 - DNA, 22 bp, Artificial Sequence
  Description of Artificial Sequence: Synthetic oligonucleotide
acgactctgtacagagtcgtcc

SEQ ID NO: 7041 - DNA, 22 bp, Artificial Sequence
  Description of Artificial Sequence: Synthetic oligonucleotide
gagactctgtacagagtctccc

SEQ ID NO: 7042 - DNA, 22 bp, Artificial Sequence
  Description of Artificial Sequence: Synthetic oligonucleotide
gcgactctgtacagagtcgcca

SEQ ID NO: 7043 - DNA, 22 bp, Artificial Sequence
  Description of Artificial Sequence: Synthetic oligonucleotide
gcgactctgtacagagtcgcac

SEQ ID NO: 7044 - DNA, 22 bp, Artificial Sequence
  Description of Artificial Sequence: Synthetic oligonucleotide
gtgactctgtacagagtcaccc

SEQ ID NO: 7045 - DNA, 22 bp, Artificial Sequence
  Description of Artificial Sequence: Synthetic oligonucleotide
gggactctgtacagagtcccgt

SEQ ID NO: 7046 - DNA, 22 bp, Artificial Sequence
  Description of Artificial Sequence: Synthetic oligonucleotide
gggactctgtacagagtccctg

SEQ ID NO: 7047 - DNA, 22 bp, Artificial Sequence
  Description of Artificial Sequence: Synthetic oligonucleotide
aggactctgtacagagtcctgg

SEQ ID NO: 7048 - DNA, 22 bp, Artificial Sequence
  Description of Artificial Sequence: Synthetic oligonucleotide
gagactctgtacagagtctcgg

SEQ ID NO: 7049 - DNA, 22 bp, Artificial Sequence
  Description of Artificial Sequence: Synthetic oligonucleotide
gggactctgtacagagtcccga

SEQ ID NO: 7050 - DNA, 22 bp, Artificial Sequence
  Description of Artificial Sequence: Synthetic oligonucleotide
gggactctgtacagagtcccag

SEQ ID NO: 7051 - DNA, 22 bp, Artificial Sequence
  Description of Artificial Sequence: Synthetic oligonucleotide
tggactctgtacagagtccagg

SEQ ID NO: 7052 - DNA, 22 bp, Artificial Sequence
  Description of Artificial Sequence: Synthetic oligonucleotide
gtgactctgtacagagtcacgg

SEQ ID NO: 7053 - DNA, 22 bp, Artificial Sequence
  Description of Artificial Sequence: Synthetic oligonucleotide
gcgactctgtacagagtcgccg

SEQ ID NO: 7054 - DNA, 22 bp, Artificial Sequence
  Description of Artificial Sequence: Synthetic oligonucleotide
gcgactctgtacagagtcgctg

SEQ ID NO: 7055 - DNA, 22 bp, Artificial Sequence
  Description of Artificial Sequence: Synthetic oligonucleotide
acgactctgtacagagtcgtcg

SEQ ID NO: 7056 - DNA, 22 bp, Artificial Sequence
  Description of Artificial Sequence: Synthetic oligonucleotide
gagactctgtacagagtctccg

SEQ ID NO: 7057 - DNA, 22 bp, Artificial Sequence
  Description of Artificial Sequence: Synthetic oligonucleotide
gcgactctgtacagagtcgcag

SEQ ID NO: 7058 - DNA, 22 bp, Artificial Sequence
  Description of Artificial Sequence: Synthetic oligonucleotide
gtgactctgtacagagtcaccg

SEQ ID NO: 7059 - DNA, 22 bp, Artificial Sequence
  Description of Artificial Sequence: Synthetic oligonucleotide
cggactctgtacagagtccgtg

SEQ ID NO: 7060 - DNA, 22 bp, Artificial Sequence
  Description of Artificial Sequence: Synthetic oligonucleotide
cagactctgtacagagtctggg

SEQ ID NO: 7061 - DNA, 22 bp, Artificial Sequence
  Description of Artificial Sequence: Synthetic oligonucleotide
cggactctgtacagagtccgag

SEQ ID NO: 7062 - DNA, 22 bp, Artificial Sequence
  Description of Artificial Sequence: Synthetic oligonucleotide
ctgactctgtacagagtcaggg

SEQ ID NO: 7063 - DNA, 22 bp, Artificial Sequence
  Description of Artificial Sequence: Synthetic oligonucleotide
acgactctgtacagagtcgtgg

SEQ ID NO: 7064 - DNA, 22 bp, Artificial Sequence
  Description of Artificial Sequence: Synthetic oligonucleotide
ccgactctgtacagagtcggct

SEQ ID NO: 7065 - DNA, 22 bp, Artificial Sequence
  Description of Artificial Sequence: Synthetic oligonucleotide
ccgactctgtacagagtcggca

SEQ ID NO: 7066 - DNA, 22 bp, Artificial Sequence
  Description of Artificial Sequence: Synthetic oligonucleotide
gagactctgtacagagtctcgc

SEQ ID NO: 7067 - DNA, 22 bp, Artificial Sequence
  Description of Artificial Sequence: Synthetic oligonucleotide
gtgactctgtacagagtcacgc

SEQ ID NO: 7068 - DNA, 22 bp, Artificial Sequence
  Description of Artificial Sequence: Synthetic oligonucleotide
aggactctgtacagagtcctgc

SEQ ID NO: 7069 - DNA, 22 bp, Artificial Sequence
  Description of Artificial Sequence: Synthetic oligonucleotide
tggactctgtacagagtccagc

SEQ ID NO: 7070 - DNA, 22 bp, Artificial Sequence
  Description of Artificial Sequence: Synthetic oligonucleotide
aggactctgtacagagtcctcg

SEQ ID NO: 7071 - DNA, 22 bp, Artificial Sequence
  Description of Artificial Sequence: Synthetic oligonucleotide
tggactctgtacagagtccacg

SEQ ID NO: 7072 - DNA, 22 bp, Artificial Sequence
  Description of Artificial Sequence: Synthetic oligonucleotide
ccgactctgtacagagtcggtg

SEQ ID NO: 7073 - DNA, 22 bp, Artificial Sequence
  Description of Artificial Sequence: Synthetic oligonucleotide
ccgactctgtacagagtcggag

SEQ ID NO: 7074 - DNA, 22 bp, Artificial Sequence
  Description of Artificial Sequence: Synthetic oligonucleotide
gggactctgtacagagtcccgc

SEQ ID NO: 7075 - DNA, 22 bp, Artificial Sequence
  Description of Artificial Sequence: Synthetic oligonucleotide
gggactctgtacagagtccctc

SEQ ID NO: 7076 - DNA, 22 bp, Artificial Sequence
  Description of Artificial Sequence: Synthetic oligonucleotide
gggactctgtacagagtcccac

SEQ ID NO: 7077 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctggccagagtcnnnn

SEQ ID NO: 7078 - DNA, 22 bp, Artificial Sequence
  Description of Artificial Sequence: Synthetic oligonucleotide
cggactctggccagagtccgcc

SEQ ID NO: 7079 - DNA, 22 bp, Artificial Sequence
  Description of Artificial Sequence: Synthetic oligonucleotide
cggactctggccagagtccgct

SEQ ID NO: 7080 - DNA, 22 bp, Artificial Sequence
  Description of Artificial Sequence: Synthetic oligonucleotide
cggactctggccagagtccgtc

SEQ ID NO: 7081 - DNA, 22 bp, Artificial Sequence
  Description of Artificial Sequence: Synthetic oligonucleotide
aggactctggccagagtcctcc

SEQ ID NO: 7082 - DNA, 22 bp, Artificial Sequence
  Description of Artificial Sequence: Synthetic oligonucleotide
cagactctggccagagtctgcc

SEQ ID NO: 7083 - DNA, 22 bp, Artificial Sequence
  Description of Artificial Sequence: Synthetic oligonucleotide
cggactctggccagagtccgca

SEQ ID NO: 7084 - DNA, 22 bp, Artificial Sequence
  Description of Artificial Sequence: Synthetic oligonucleotide
cggactctggccagagtccgac

SEQ ID NO: 7085 - DNA, 22 bp, Artificial Sequence
  Description of Artificial Sequence: Synthetic oligonucleotide
tggactctggccagagtccacc

SEQ ID NO: 7086 - DNA, 22 bp, Artificial Sequence
  Description of Artificial Sequence: Synthetic oligonucleotide
ctgactctggccagagtcagcc

SEQ ID NO: 7087 - DNA, 22 bp, Artificial Sequence
  Description of Artificial Sequence: Synthetic oligonucleotide
ccgactctggccagagtcgggc

SEQ ID NO: 7088 - DNA, 22 bp, Artificial Sequence
  Description of Artificial Sequence: Synthetic oligonucleotide
ccgactctggccagagtcgggt

SEQ ID NO: 7089 - DNA, 22 bp, Artificial Sequence
  Description of Artificial Sequence: Synthetic oligonucleotide
ccgactctggccagagtcggtc

SEQ ID NO: 7090 - DNA, 22 bp, Artificial Sequence
  Description of Artificial Sequence: Synthetic oligonucleotide
acgactctggccagagtcgtgc

SEQ ID NO: 7091 - DNA, 22 bp, Artificial Sequence
  Description of Artificial Sequence: Synthetic oligonucleotide
cagactctggccagagtctggc

SEQ ID NO: 7092 - DNA, 22 bp, Artificial Sequence
  Description of Artificial Sequence: Synthetic oligonucleotide
ccgactctggccagagtcggga

SEQ ID NO: 7093 - DNA, 22 bp, Artificial Sequence
  Description of Artificial Sequence: Synthetic oligonucleotide
ccgactctggccagagtcggac

SEQ ID NO: 7094 - DNA, 22 bp, Artificial Sequence
  Description of Artificial Sequence: Synthetic oligonucleotide
ctgactctggccagagtcaggc

SEQ ID NO: 7095 - DNA, 22 bp, Artificial Sequence
  Description of Artificial Sequence: Synthetic oligonucleotide
gcgactctggccagagtcgccc

SEQ ID NO: 7096 - DNA, 22 bp, Artificial Sequence
  Description of Artificial Sequence: Synthetic oligonucleotide
gcgactctggccagagtcgcct

SEQ ID NO: 7097 - DNA, 22 bp, Artificial Sequence
  Description of Artificial Sequence: Synthetic oligonucleotide
gcgactctggccagagtcgctc

SEQ ID NO: 7098 - DNA, 22 bp, Artificial Sequence
  Description of Artificial Sequence: Synthetic oligonucleotide
acgactctggccagagtcgtcc

SEQ ID NO: 7099 - DNA, 22 bp, Artificial Sequence
  Description of Artificial Sequence: Synthetic oligonucleotide
gagactctggccagagtctccc

SEQ ID NO: 7100 - DNA, 22 bp, Artificial Sequence
  Description of Artificial Sequence: Synthetic oligonucleotide
gcgactctggccagagtcgcca

SEQ ID NO: 7101 - DNA, 22 bp, Artificial Sequence
  Description of Artificial Sequence: Synthetic oligonucleotide
gcgactctggccagagtcgcac

SEQ ID NO: 7102 - DNA, 22 bp, Artificial Sequence
  Description of Artificial Sequence: Synthetic oligonucleotide
gtgactctggccagagtcaccc

SEQ ID NO: 7103 - DNA, 22 bp, Artificial Sequence
  Description of Artificial Sequence: Synthetic oligonucleotide
gggactctggccagagtcccgt

SEQ ID NO: 7104 - DNA, 22 bp, Artificial Sequence
  Description of Artificial Sequence: Synthetic oligonucleotide
gggactctggccagagtccctg

SEQ ID NO: 7105 - DNA, 22 bp, Artificial Sequence
  Description of Artificial Sequence: Synthetic oligonucleotide
aggactctggccagagtcctgg

SEQ ID NO: 7106 - DNA, 22 bp, Artificial Sequence
  Description of Artificial Sequence: Synthetic oligonucleotide
gagactctggccagagtctcgg

SEQ ID NO: 7107 - DNA, 22 bp, Artificial Sequence
  Description of Artificial Sequence: Synthetic oligonucleotide
gggactctggccagagtcccga

SEQ ID NO: 7108 - DNA, 22 bp, Artificial Sequence
  Description of Artificial Sequence: Synthetic oligonucleotide
gggactctggccagagtcccag

SEQ ID NO: 7109 - DNA, 22 bp, Artificial Sequence
  Description of Artificial Sequence: Synthetic oligonucleotide
tggactctggccagagtccagg

SEQ ID NO: 7110 - DNA, 22 bp, Artificial Sequence
  Description of Artificial Sequence: Synthetic oligonucleotide
gtgactctggccagagtcacgg

SEQ ID NO: 7111 - DNA, 22 bp, Artificial Sequence
  Description of Artificial Sequence: Synthetic oligonucleotide
gcgactctggccagagtcgccg

SEQ ID NO: 7112 - DNA, 22 bp, Artificial Sequence
  Description of Artificial Sequence: Synthetic oligonucleotide
gcgactctggccagagtcgctg

SEQ ID NO: 7113 - DNA, 22 bp, Artificial Sequence
  Description of Artificial Sequence: Synthetic oligonucleotide
acgactctggccagagtcgtcg

SEQ ID NO: 7114 - DNA, 22 bp, Artificial Sequence
  Description of Artificial Sequence: Synthetic oligonucleotide
gagactctggccagagtctccg

SEQ ID NO: 7115 - DNA, 22 bp, Artificial Sequence
  Description of Artificial Sequence: Synthetic oligonucleotide
gcgactctggccagagtcgcag

SEQ ID NO: 7116 - DNA, 22 bp, Artificial Sequence
  Description of Artificial Sequence: Synthetic oligonucleotide
gtgactctggccagagtcaccg

SEQ ID NO: 7117 - DNA, 22 bp, Artificial Sequence
  Description of Artificial Sequence: Synthetic oligonucleotide
cggactctggccagagtccgtg

SEQ ID NO: 7118 - DNA, 22 bp, Artificial Sequence
  Description of Artificial Sequence: Synthetic oligonucleotide
cagactctggccagagtctggg

SEQ ID NO: 7119 - DNA, 22 bp, Artificial Sequence
  Description of Artificial Sequence: Synthetic oligonucleotide
cggactctggccagagtccgag

SEQ ID NO: 7120 - DNA, 22 bp, Artificial Sequence
  Description of Artificial Sequence: Synthetic oligonucleotide
ctgactctggccagagtcaggg

SEQ ID NO: 7121 - DNA, 22 bp, Artificial Sequence
  Description of Artificial Sequence: Synthetic oligonucleotide
acgactctggccagagtcgtgg

SEQ ID NO: 7122 - DNA, 22 bp, Artificial Sequence
  Description of Artificial Sequence: Synthetic oligonucleotide
ccgactctggccagagtcggct

SEQ ID NO: 7123 - DNA, 22 bp, Artificial Sequence
  Description of Artificial Sequence: Synthetic oligonucleotide
ccgactctggccagagtcggca

SEQ ID NO: 7124 - DNA, 22 bp, Artificial Sequence
  Description of Artificial Sequence: Synthetic oligonucleotide
gagactctggccagagtctcgc

SEQ ID NO: 7125 - DNA, 22 bp, Artificial Sequence
  Description of Artificial Sequence: Synthetic oligonucleotide
gtgactctggccagagtcacgc

SEQ ID NO: 7126 - DNA, 22 bp, Artificial Sequence
  Description of Artificial Sequence: Synthetic oligonucleotide
aggactctggccagagtcctgc

SEQ ID NO: 7127 - DNA, 22 bp, Artificial Sequence
  Description of Artificial Sequence: Synthetic oligonucleotide
tggactctggccagagtccagc

SEQ ID NO: 7128 - DNA, 22 bp, Artificial Sequence
  Description of Artificial Sequence: Synthetic oligonucleotide
aggactctggccagagtcctcg

SEQ ID NO: 7129 - DNA, 22 bp, Artificial Sequence
  Description of Artificial Sequence: Synthetic oligonucleotide
tggactctggccagagtccacg

SEQ ID NO: 7130 - DNA, 22 bp, Artificial Sequence
  Description of Artificial Sequence: Synthetic oligonucleotide
ccgactctggccagagtcggtg

SEQ ID NO: 7131 - DNA, 22 bp, Artificial Sequence
  Description of Artificial Sequence: Synthetic oligonucleotide
ccgactctggccagagtcggag

SEQ ID NO: 7132 - DNA, 22 bp, Artificial Sequence
  Description of Artificial Sequence: Synthetic oligonucleotide
gggactctggccagagtcccgc

SEQ ID NO: 7133 - DNA, 22 bp, Artificial Sequence
  Description of Artificial Sequence: Synthetic oligonucleotide
gggactctggccagagtccctc

SEQ ID NO: 7134 - DNA, 22 bp, Artificial Sequence
  Description of Artificial Sequence: Synthetic oligonucleotide
gggactctggccagagtcccac

SEQ ID NO: 7135 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctgcgcagagtcnnnn

SEQ ID NO: 7136 - DNA, 22 bp, Artificial Sequence
  Description of Artificial Sequence: Synthetic oligonucleotide
cggactctgcgcagagtccgcc

SEQ ID NO: 7137 - DNA, 22 bp, Artificial Sequence
  Description of Artificial Sequence: Synthetic oligonucleotide
cggactctgcgcagagtccgct

SEQ ID NO: 7138 - DNA, 22 bp, Artificial Sequence
  Description of Artificial Sequence: Synthetic oligonucleotide
cggactctgcgcagagtccgtc

SEQ ID NO: 7139 - DNA, 22 bp, Artificial Sequence
  Description of Artificial Sequence: Synthetic oligonucleotide
aggactctgcgcagagtcctcc

SEQ ID NO: 7140 - DNA, 22 bp, Artificial Sequence
  Description of Artificial Sequence: Synthetic oligonucleotide
cagactctgcgcagagtctgcc

SEQ ID NO: 7141 - DNA, 22 bp, Artificial Sequence
  Description of Artificial Sequence: Synthetic oligonucleotide
cggactctgcgcagagtccgca

SEQ ID NO: 7142 - DNA, 22 bp, Artificial Sequence
  Description of Artificial Sequence: Synthetic oligonucleotide
cggactctgcgcagagtccgac

SEQ ID NO: 7143 - DNA, 22 bp, Artificial Sequence
  Description of Artificial Sequence: Synthetic oligonucleotide
tggactctgcgcagagtccacc

SEQ ID NO: 7144 - DNA, 22 bp, Artificial Sequence
  Description of Artificial Sequence: Synthetic oligonucleotide
ctgactctgcgcagagtcagcc

SEQ ID NO: 7145 - DNA, 22 bp, Artificial Sequence
  Description of Artificial Sequence: Synthetic oligonucleotide
ccgactctgcgcagagtcgggc

SEQ ID NO: 7146 - DNA, 22 bp, Artificial Sequence
  Description of Artificial Sequence: Synthetic oligonucleotide
ccgactctgcgcagagtcgggt

SEQ ID NO: 7147 - DNA, 22 bp, Artificial Sequence
  Description of Artificial Sequence: Synthetic oligonucleotide
ccgactctgcgcagagtcggtc

SEQ ID NO: 7148 - DNA, 22 bp, Artificial Sequence
  Description of Artificial Sequence: Synthetic oligonucleotide
acgactctgcgcagagtcgtgc

SEQ ID NO: 7149 - DNA, 22 bp, Artificial Sequence
  Description of Artificial Sequence: Synthetic oligonucleotide
cagactctgcgcagagtctggc

SEQ ID NO: 7150 - DNA, 22 bp, Artificial Sequence
  Description of Artificial Sequence: Synthetic oligonucleotide
ccgactctgcgcagagtcggga

SEQ ID NO: 7151 - DNA, 22 bp, Artificial Sequence
  Description of Artificial Sequence: Synthetic oligonucleotide
ccgactctgcgcagagtcggac

SEQ ID NO: 7152 - DNA, 22 bp, Artificial Sequence
  Description of Artificial Sequence: Synthetic oligonucleotide
ctgactctgcgcagagtcaggc

SEQ ID NO: 7153 - DNA, 22 bp, Artificial Sequence
  Description of Artificial Sequence: Synthetic oligonucleotide
gcgactctgcgcagagtcgccc

SEQ ID NO: 7154 - DNA, 22 bp, Artificial Sequence
  Description of Artificial Sequence: Synthetic oligonucleotide
gcgactctgcgcagagtcgcct

SEQ ID NO: 7155 - DNA, 22 bp, Artificial Sequence
  Description of Artificial Sequence: Synthetic oligonucleotide
gcgactctgcgcagagtcgctc

SEQ ID NO: 7156 - DNA, 22 bp, Artificial Sequence
  Description of Artificial Sequence: Synthetic oligonucleotide
acgactctgcgcagagtcgtcc

SEQ ID NO: 7157 - DNA, 22 bp, Artificial Sequence
  Description of Artificial Sequence: Synthetic oligonucleotide
gagactctgcgcagagtctccc

SEQ ID NO: 7158 - DNA, 22 bp, Artificial Sequence
  Description of Artificial Sequence: Synthetic oligonucleotide
gcgactctgcgcagagtcgcca

SEQ ID NO: 7159 - DNA, 22 bp, Artificial Sequence
  Description of Artificial Sequence: Synthetic oligonucleotide
gcgactctgcgcagagtcgcac

SEQ ID NO: 7160 - DNA, 22 bp, Artificial Sequence
  Description of Artificial Sequence: Synthetic oligonucleotide
gtgactctgcgcagagtcaccc

SEQ ID NO: 7161 - DNA, 22 bp, Artificial Sequence
  Description of Artificial Sequence: Synthetic oligonucleotide
gggactctgcgcagagtcccgt

SEQ ID NO: 7162 - DNA, 22 bp, Artificial Sequence
  Description of Artificial Sequence: Synthetic oligonucleotide
gggactctgcgcagagtccctg

SEQ ID NO: 7163 - DNA, 22 bp, Artificial Sequence
  Description of Artificial Sequence: Synthetic oligonucleotide
aggactctgcgcagagtcctgg

SEQ ID NO: 7164 - DNA, 22 bp, Artificial Sequence
  Description of Artificial Sequence: Synthetic oligonucleotide
gagactctgcgcagagtctcgg

SEQ ID NO: 7165 - DNA, 22 bp, Artificial Sequence
  Description of Artificial Sequence: Synthetic oligonucleotide
gggactctgcgcagagtcccga

SEQ ID NO: 7166 - DNA, 22 bp, Artificial Sequence
  Description of Artificial Sequence: Synthetic oligonucleotide
gggactctgcgcagagtcccag

SEQ ID NO: 7167 - DNA, 22 bp, Artificial Sequence
  Description of Artificial Sequence: Synthetic oligonucleotide
tggactctgcgcagagtccagg

SEQ ID NO: 7168 - DNA, 22 bp, Artificial Sequence
  Description of Artificial Sequence: Synthetic oligonucleotide
gtgactctgcgcagagtcacgg

SEQ ID NO: 7169 - DNA, 22 bp, Artificial Sequence
  Description of Artificial Sequence: Synthetic oligonucleotide
gcgactctgcgcagagtcgccg

SEQ ID NO: 7170 - DNA, 22 bp, Artificial Sequence
  Description of Artificial Sequence: Synthetic oligonucleotide
gcgactctgcgcagagtcgctg

SEQ ID NO: 7171 - DNA, 22 bp, Artificial Sequence
  Description of Artificial Sequence: Synthetic oligonucleotide
acgactctgcgcagagtcgtcg

SEQ ID NO: 7172 - DNA, 22 bp, Artificial Sequence
  Description of Artificial Sequence: Synthetic oligonucleotide
gagactctgcgcagagtctccg

SEQ ID NO: 7173 - DNA, 22 bp, Artificial Sequence
  Description of Artificial Sequence: Synthetic oligonucleotide
gcgactctgcgcagagtcgcag

SEQ ID NO: 7174 - DNA, 22 bp, Artificial Sequence
  Description of Artificial Sequence: Synthetic oligonucleotide
gtgactctgcgcagagtcaccg

SEQ ID NO: 7175 - DNA, 22 bp, Artificial Sequence
  Description of Artificial Sequence: Synthetic oligonucleotide
cggactctgcgcagagtccgtg

SEQ ID NO: 7176 - DNA, 22 bp, Artificial Sequence
  Description of Artificial Sequence: Synthetic oligonucleotide
cagactctgcgcagagtctggg

SEQ ID NO: 7177 - DNA, 22 bp, Artificial Sequence
  Description of Artificial Sequence: Synthetic oligonucleotide
cggactctgcgcagagtccgag

SEQ ID NO: 7178 - DNA, 22 bp, Artificial Sequence
  Description of Artificial Sequence: Synthetic oligonucleotide
ctgactctgcgcagagtcaggg

SEQ ID NO: 7179 - DNA, 22 bp, Artificial Sequence
  Description of Artificial Sequence: Synthetic oligonucleotide
acgactctgcgcagagtcgtgg

SEQ ID NO: 7180 - DNA, 22 bp, Artificial Sequence
  Description of Artificial Sequence: Synthetic oligonucleotide
ccgactctgcgcagagtcggct

SEQ ID NO: 7181 - DNA, 22 bp, Artificial Sequence
  Description of Artificial Sequence: Synthetic oligonucleotide
ccgactctgcgcagagtcggca

SEQ ID NO: 7182 - DNA, 22 bp, Artificial Sequence
  Description of Artificial Sequence: Synthetic oligonucleotide
gagactctgcgcagagtctcgc

SEQ ID NO: 7183 - DNA, 22 bp, Artificial Sequence
  Description of Artificial Sequence: Synthetic oligonucleotide
gtgactctgcgcagagtcacgc

SEQ ID NO: 7184 - DNA, 22 bp, Artificial Sequence
  Description of Artificial Sequence: Synthetic oligonucleotide
aggactctgcgcagagtcctgc

SEQ ID NO: 7185 - DNA, 22 bp, Artificial Sequence
  Description of Artificial Sequence: Synthetic oligonucleotide
tggactctgcgcagagtccagc

SEQ ID NO: 7186 - DNA, 22 bp, Artificial Sequence
  Description of Artificial Sequence: Synthetic oligonucleotide
aggactctgcgcagagtcctcg

SEQ ID NO: 7187 - DNA, 22 bp, Artificial Sequence
  Description of Artificial Sequence: Synthetic oligonucleotide
tggactctgcgcagagtccacg

SEQ ID NO: 7188 - DNA, 22 bp, Artificial Sequence
  Description of Artificial Sequence: Synthetic oligonucleotide
ccgactctgcgcagagtcggtg

SEQ ID NO: 7189 - DNA, 22 bp, Artificial Sequence
  Description of Artificial Sequence: Synthetic oligonucleotide
ccgactctgcgcagagtcggag

SEQ ID NO: 7190 - DNA, 22 bp, Artificial Sequence
  Description of Artificial Sequence: Synthetic oligonucleotide
gggactctgcgcagagtcccgc

SEQ ID NO: 7191 - DNA, 22 bp, Artificial Sequence
  Description of Artificial Sequence: Synthetic oligonucleotide
gggactctgcgcagagtccctc

SEQ ID NO: 7192 - DNA, 22 bp, Artificial Sequence
  Description of Artificial Sequence: Synthetic oligonucleotide
gggactctgcgcagagtcccac

SEQ ID NO: 7193 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgcatgcgagtcnnnn

SEQ ID NO: 7194 - DNA, 22 bp, Artificial Sequence
  Description of Artificial Sequence: Synthetic oligonucleotide
cggactcgcatgcgagtccgcc

SEQ ID NO: 7195 - DNA, 22 bp, Artificial Sequence
  Description of Artificial Sequence: Synthetic oligonucleotide
cggactcgcatgcgagtccgct

SEQ ID NO: 7196 - DNA, 22 bp, Artificial Sequence
  Description of Artificial Sequence: Synthetic oligonucleotide
cggactcgcatgcgagtccgtc

SEQ ID NO: 7197 - DNA, 22 bp, Artificial Sequence
  Description of Artificial Sequence: Synthetic oligonucleotide
aggactcgcatgcgagtcctcc

SEQ ID NO: 7198 - DNA, 22 bp, Artificial Sequence
  Description of Artificial Sequence: Synthetic oligonucleotide
cagactcgcatgcgagtctgcc

SEQ ID NO: 7199 - DNA, 22 bp, Artificial Sequence
  Description of Artificial Sequence: Synthetic oligonucleotide
cggactcgcatgcgagtccgca

SEQ ID NO: 7200 - DNA, 22 bp, Artificial Sequence
  Description of Artificial Sequence: Synthetic oligonucleotide
cggactcgcatgcgagtccgac

SEQ ID NO: 7201 - DNA, 22 bp, Artificial Sequence
  Description of Artificial Sequence: Synthetic oligonucleotide
tggactcgcatgcgagtccacc

SEQ ID NO: 7202 - DNA, 22 bp, Artificial Sequence
  Description of Artificial Sequence: Synthetic oligonucleotide
ctgactcgcatgcgagtcagcc

SEQ ID NO: 7203 - DNA, 22 bp, Artificial Sequence
  Description of Artificial Sequence: Synthetic oligonucleotide
ccgactcgcatgcgagtcgggc

SEQ ID NO: 7204 - DNA, 22 bp, Artificial Sequence
  Description of Artificial Sequence: Synthetic oligonucleotide
ccgactcgcatgcgagtcgggt

SEQ ID NO: 7205 - DNA, 22 bp, Artificial Sequence
  Description of Artificial Sequence: Synthetic oligonucleotide
ccgactcgcatgcgagtcggtc

SEQ ID NO: 7206 - DNA, 22 bp, Artificial Sequence
  Description of Artificial Sequence: Synthetic oligonucleotide
acgactcgcatgcgagtcgtgc

SEQ ID NO: 7207 - DNA, 22 bp, Artificial Sequence
  Description of Artificial Sequence: Synthetic oligonucleotide
cagactcgcatgcgagtctggc

SEQ ID NO: 7208 - DNA, 22 bp, Artificial Sequence
  Description of Artificial Sequence: Synthetic oligonucleotide
ccgactcgcatgcgagtcggga

SEQ ID NO: 7209 - DNA, 22 bp, Artificial Sequence
  Description of Artificial Sequence: Synthetic oligonucleotide
ccgactcgcatgcgagtcggac

SEQ ID NO: 7210 - DNA, 22 bp, Artificial Sequence
  Description of Artificial Sequence: Synthetic oligonucleotide
ctgactcgcatgcgagtcaggc

SEQ ID NO: 7211 - DNA, 22 bp, Artificial Sequence
  Description of Artificial Sequence: Synthetic oligonucleotide
gcgactcgcatgcgagtcgccc

SEQ ID NO: 7212 - DNA, 22 bp, Artificial Sequence
  Description of Artificial Sequence: Synthetic oligonucleotide
gcgactcgcatgcgagtcgcct

SEQ ID NO: 7213 - DNA, 22 bp, Artificial Sequence
  Description of Artificial Sequence: Synthetic oligonucleotide
gcgactcgcatgcgagtcgctc

SEQ ID NO: 7214 - DNA, 22 bp, Artificial Sequence
  Description of Artificial Sequence: Synthetic oligonucleotide
acgactcgcatgcgagtcgtcc

SEQ ID NO: 7215 - DNA, 22 bp, Artificial Sequence
  Description of Artificial Sequence: Synthetic oligonucleotide
gagactcgcatgcgagtctccc

SEQ ID NO: 7216 - DNA, 22 bp, Artificial Sequence
  Description of Artificial Sequence: Synthetic oligonucleotide
gcgactcgcatgcgagtcgcca

SEQ ID NO: 7217 - DNA, 22 bp, Artificial Sequence
  Description of Artificial Sequence: Synthetic oligonucleotide
gcgactcgcatgcgagtcgcac

SEQ ID NO: 7218 - DNA, 22 bp, Artificial Sequence
  Description of Artificial Sequence: Synthetic oligonucleotide
gtgactcgcatgcgagtcaccc

SEQ ID NO: 7219 - DNA, 22 bp, Artificial Sequence
  Description of Artificial Sequence: Synthetic oligonucleotide
gggactcgcatgcgagtcccgt

SEQ ID NO: 7220 - DNA, 22 bp, Artificial Sequence
  Description of Artificial Sequence: Synthetic oligonucleotide
gggactcgcatgcgagtccctg

SEQ ID NO: 7221 - DNA, 22 bp, Artificial Sequence
  Description of Artificial Sequence: Synthetic oligonucleotide
aggactcgcatgcgagtcctgg

SEQ ID NO: 7222 - DNA, 22 bp, Artificial Sequence
  Description of Artificial Sequence: Synthetic oligonucleotide
gagactcgcatgcgagtctcgg

SEQ ID NO: 7223 - DNA, 22 bp, Artificial Sequence
  Description of Artificial Sequence: Synthetic oligonucleotide
gggactcgcatgcgagtcccga

SEQ ID NO: 7224 - DNA, 22 bp, Artificial Sequence
  Description of Artificial Sequence: Synthetic oligonucleotide
gggactcgcatgcgagtcccag

SEQ ID NO: 7225 - DNA, 22 bp, Artificial Sequence
  Description of Artificial Sequence: Synthetic oligonucleotide
tggactcgcatgcgagtccagg

SEQ ID NO: 7226 - DNA, 22 bp, Artificial Sequence
  Description of Artificial Sequence: Synthetic oligonucleotide
gtgactcgcatgcgagtcacgg

SEQ ID NO: 7227 - DNA, 22 bp, Artificial Sequence
  Description of Artificial Sequence: Synthetic oligonucleotide
gcgactcgcatgcgagtcgccg

SEQ ID NO: 7228 - DNA, 22 bp, Artificial Sequence
  Description of Artificial Sequence: Synthetic oligonucleotide
gcgactcgcatgcgagtcgctg

SEQ ID NO: 7229 - DNA, 22 bp, Artificial Sequence
  Description of Artificial Sequence: Synthetic oligonucleotide
acgactcgcatgcgagtcgtcg

SEQ ID NO: 7230 - DNA, 22 bp, Artificial Sequence
  Description of Artificial Sequence: Synthetic oligonucleotide
gagactcgcatgcgagtctccg

SEQ ID NO: 7231 - DNA, 22 bp, Artificial Sequence
  Description of Artificial Sequence: Synthetic oligonucleotide
gcgactcgcatgcgagtcgcag

SEQ ID NO: 7232 - DNA, 22 bp, Artificial Sequence
  Description of Artificial Sequence: Synthetic oligonucleotide
gtgactcgcatgcgagtcaccg

SEQ ID NO: 7233 - DNA, 22 bp, Artificial Sequence
  Description of Artificial Sequence: Synthetic oligonucleotide
cggactcgcatgcgagtccgtg

SEQ ID NO: 7234 - DNA, 22 bp, Artificial Sequence
  Description of Artificial Sequence: Synthetic oligonucleotide
cagactcgcatgcgagtctggg

SEQ ID NO: 7235 - DNA, 22 bp, Artificial Sequence
  Description of Artificial Sequence: Synthetic oligonucleotide
cggactcgcatgcgagtccgag

SEQ ID NO: 7236 - DNA, 22 bp, Artificial Sequence
  Description of Artificial Sequence: Synthetic oligonucleotide
ctgactcgcatgcgagtcaggg

SEQ ID NO: 7237 - DNA, 22 bp, Artificial Sequence
  Description of Artificial Sequence: Synthetic oligonucleotide
acgactcgcatgcgagtcgtgg

SEQ ID NO: 7238 - DNA, 22 bp, Artificial Sequence
  Description of Artificial Sequence: Synthetic oligonucleotide
ccgactcgcatgcgagtcggct

SEQ ID NO: 7239 - DNA, 22 bp, Artificial Sequence
  Description of Artificial Sequence: Synthetic oligonucleotide
ccgactcgcatgcgagtcggca

SEQ ID NO: 7240 - DNA, 22 bp, Artificial Sequence
  Description of Artificial Sequence: Synthetic oligonucleotide
gagactcgcatgcgagtctcgc

SEQ ID NO: 7241 - DNA, 22 bp, Artificial Sequence
  Description of Artificial Sequence: Synthetic oligonucleotide
gtgactcgcatgcgagtcacgc

SEQ ID NO: 7242 - DNA, 22 bp, Artificial Sequence
  Description of Artificial Sequence: Synthetic oligonucleotide
aggactcgcatgcgagtcctgc

SEQ ID NO: 7243 - DNA, 22 bp, Artificial Sequence
  Description of Artificial Sequence: Synthetic oligonucleotide
tggactcgcatgcgagtccagc

SEQ ID NO: 7244 - DNA, 22 bp, Artificial Sequence
  Description of Artificial Sequence: Synthetic oligonucleotide
aggactcgcatgcgagtcctcg

SEQ ID NO: 7245 - DNA, 22 bp, Artificial Sequence
  Description of Artificial Sequence: Synthetic oligonucleotide
tggactcgcatgcgagtccacg

SEQ ID NO: 7246 - DNA, 22 bp, Artificial Sequence
  Description of Artificial Sequence: Synthetic oligonucleotide
ccgactcgcatgcgagtcggtg

SEQ ID NO: 7247 - DNA, 22 bp, Artificial Sequence
  Description of Artificial Sequence: Synthetic oligonucleotide
ccgactcgcatgcgagtcggag

SEQ ID NO: 7248 - DNA, 22 bp, Artificial Sequence
  Description of Artificial Sequence: Synthetic oligonucleotide
gggactcgcatgcgagtcccgc

SEQ ID NO: 7249 - DNA, 22 bp, Artificial Sequence
  Description of Artificial Sequence: Synthetic oligonucleotide
gggactcgcatgcgagtccctc

SEQ ID NO: 7250 - DNA, 22 bp, Artificial Sequence
  Description of Artificial Sequence: Synthetic oligonucleotide
gggactcgcatgcgagtcccac

SEQ ID NO: 7251 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgctagcgagtcnnnn

SEQ ID NO: 7252 - DNA, 22 bp, Artificial Sequence
  Description of Artificial Sequence: Synthetic oligonucleotide
cggactcgctagcgagtccgcc

SEQ ID NO: 7253 - DNA, 22 bp, Artificial Sequence
  Description of Artificial Sequence: Synthetic oligonucleotide
cggactcgctagcgagtccgct

SEQ ID NO: 7254 - DNA, 22 bp, Artificial Sequence
  Description of Artificial Sequence: Synthetic oligonucleotide
cggactcgctagcgagtccgtc

SEQ ID NO: 7255 - DNA, 22 bp, Artificial Sequence
  Description of Artificial Sequence: Synthetic oligonucleotide
aggactcgctagcgagtcctcc

SEQ ID NO: 7256 - DNA, 22 bp, Artificial Sequence
  Description of Artificial Sequence: Synthetic oligonucleotide
cagactcgctagcgagtctgcc

SEQ ID NO: 7257 - DNA, 22 bp, Artificial Sequence
  Description of Artificial Sequence: Synthetic oligonucleotide
cggactcgctagcgagtccgca

SEQ ID NO: 7258 - DNA, 22 bp, Artificial Sequence
  Description of Artificial Sequence: Synthetic oligonucleotide
cggactcgctagcgagtccgac

SEQ ID NO: 7259 - DNA, 22 bp, Artificial Sequence
  Description of Artificial Sequence: Synthetic oligonucleotide
tggactcgctagcgagtccacc

SEQ ID NO: 7260 - DNA, 22 bp, Artificial Sequence
  Description of Artificial Sequence: Synthetic oligonucleotide
ctgactcgctagcgagtcagcc

SEQ ID NO: 7261 - DNA, 22 bp, Artificial Sequence
  Description of Artificial Sequence: Synthetic oligonucleotide
ccgactcgctagcgagtcgggc

SEQ ID NO: 7262 - DNA, 22 bp, Artificial Sequence
  Description of Artificial Sequence: Synthetic oligonucleotide
ccgactcgctagcgagtcgggt

SEQ ID NO: 7263 - DNA, 22 bp, Artificial Sequence
  Description of Artificial Sequence: Synthetic oligonucleotide
ccgactcgctagcgagtcggtc

SEQ ID NO: 7264 - DNA, 22 bp, Artificial Sequence
  Description of Artificial Sequence: Synthetic oligonucleotide
acgactcgctagcgagtcgtgc

SEQ ID NO: 7265 - DNA, 22 bp, Artificial Sequence
  Description of Artificial Sequence: Synthetic oligonucleotide
cagactcgctagcgagtctggc

SEQ ID NO: 7266 - DNA, 22 bp, Artificial Sequence
  Description of Artificial Sequence: Synthetic oligonucleotide
ccgactcgctagcgagtcggga

SEQ ID NO: 7267 - DNA, 22 bp, Artificial Sequence
  Description of Artificial Sequence: Synthetic oligonucleotide
ccgactcgctagcgagtcggac

SEQ ID NO: 7268 - DNA, 22 bp, Artificial Sequence
  Description of Artificial Sequence: Synthetic oligonucleotide
ctgactcgctagcgagtcaggc

SEQ ID NO: 7269 - DNA, 22 bp, Artificial Sequence
  Description of Artificial Sequence: Synthetic oligonucleotide
gcgactcgctagcgagtcgccc

SEQ ID NO: 7270 - DNA, 22 bp, Artificial Sequence
  Description of Artificial Sequence: Synthetic oligonucleotide
gcgactcgctagcgagtcgcct

SEQ ID NO: 7271 - DNA, 22 bp, Artificial Sequence
  Description of Artificial Sequence: Synthetic oligonucleotide
gcgactcgctagcgagtcgctc

SEQ ID NO: 7272 - DNA, 22 bp, Artificial Sequence
  Description of Artificial Sequence: Synthetic oligonucleotide
acgactcgctagcgagtcgtcc

SEQ ID NO: 7273 - DNA, 22 bp, Artificial Sequence
  Description of Artificial Sequence: Synthetic oligonucleotide
gagactcgctagcgagtctccc

SEQ ID NO: 7274 - DNA, 22 bp, Artificial Sequence
  Description of Artificial Sequence: Synthetic oligonucleotide
gcgactcgctagcgagtcgcca

SEQ ID NO: 7275 - DNA, 22 bp, Artificial Sequence
  Description of Artificial Sequence: Synthetic oligonucleotide
gcgactcgctagcgagtcgcac

SEQ ID NO: 7276 - DNA, 22 bp, Artificial Sequence
  Description of Artificial Sequence: Synthetic oligonucleotide
gtgactcgctagcgagtcaccc

SEQ ID NO: 7277 - DNA, 22 bp, Artificial Sequence
  Description of Artificial Sequence: Synthetic oligonucleotide
gggactcgctagcgagtcccgt

SEQ ID NO: 7278 - DNA, 22 bp, Artificial Sequence
  Description of Artificial Sequence: Synthetic oligonucleotide
gggactcgctagcgagtccctg

SEQ ID NO: 7279 - DNA, 22 bp, Artificial Sequence
  Description of Artificial Sequence: Synthetic oligonucleotide
aggactcgctagcgagtcctgg

SEQ ID NO: 7280 - DNA, 22 bp, Artificial Sequence
  Description of Artificial Sequence: Synthetic oligonucleotide
gagactcgctagcgagtctcgg

SEQ ID NO: 7281 - DNA, 22 bp, Artificial Sequence
  Description of Artificial Sequence: Synthetic oligonucleotide
gggactcgctagcgagtcccga

SEQ ID NO: 7282 - DNA, 22 bp, Artificial Sequence
  Description of Artificial Sequence: Synthetic oligonucleotide
gggactcgctagcgagtcccag

SEQ ID NO: 7283 - DNA, 22 bp, Artificial Sequence
  Description of Artificial Sequence: Synthetic oligonucleotide
tggactcgctagcgagtccagg

SEQ ID NO: 7284 - DNA, 22 bp, Artificial Sequence
  Description of Artificial Sequence: Synthetic oligonucleotide
gtgactcgctagcgagtcacgg

SEQ ID NO: 7285 - DNA, 22 bp, Artificial Sequence
  Description of Artificial Sequence: Synthetic oligonucleotide
gcgactcgctagcgagtcgccg

SEQ ID NO: 7286 - DNA, 22 bp, Artificial Sequence
  Description of Artificial Sequence: Synthetic oligonucleotide
gcgactcgctagcgagtcgctg

SEQ ID NO: 7287 - DNA, 22 bp, Artificial Sequence
  Description of Artificial Sequence: Synthetic oligonucleotide
acgactcgctagcgagtcgtcg

SEQ ID NO: 7288 - DNA, 22 bp, Artificial Sequence
  Description of Artificial Sequence: Synthetic oligonucleotide
gagactcgctagcgagtctccg

SEQ ID NO: 7289 - DNA, 22 bp, Artificial Sequence
  Description of Artificial Sequence: Synthetic oligonucleotide
gcgactcgctagcgagtcgcag

SEQ ID NO: 7290 - DNA, 22 bp, Artificial Sequence
  Description of Artificial Sequence: Synthetic oligonucleotide
gtgactcgctagcgagtcaccg

SEQ ID NO: 7291 - DNA, 22 bp, Artificial Sequence
  Description of Artificial Sequence: Synthetic oligonucleotide
cggactcgctagcgagtccgtg

SEQ ID NO: 7292 - DNA, 22 bp, Artificial Sequence
  Description of Artificial Sequence: Synthetic oligonucleotide
cagactcgctagcgagtctggg

SEQ ID NO: 7293 - DNA, 22 bp, Artificial Sequence
  Description of Artificial Sequence: Synthetic oligonucleotide
cggactcgctagcgagtccgag

SEQ ID NO: 7294 - DNA, 22 bp, Artificial Sequence
  Description of Artificial Sequence: Synthetic oligonucleotide
ctgactcgctagcgagtcaggg

SEQ ID NO: 7295 - DNA, 22 bp, Artificial Sequence
  Description of Artificial Sequence: Synthetic oligonucleotide
acgactcgctagcgagtcgtgg

SEQ ID NO: 7296 - DNA, 22 bp, Artificial Sequence
  Description of Artificial Sequence: Synthetic oligonucleotide
ccgactcgctagcgagtcggct

SEQ ID NO: 7297 - DNA, 22 bp, Artificial Sequence
  Description of Artificial Sequence: Synthetic oligonucleotide
ccgactcgctagcgagtcggca

SEQ ID NO: 7298 - DNA, 22 bp, Artificial Sequence
  Description of Artificial Sequence: Synthetic oligonucleotide
gagactcgctagcgagtctcgc

SEQ ID NO: 7299 - DNA, 22 bp, Artificial Sequence
  Description of Artificial Sequence: Synthetic oligonucleotide
gtgactcgctagcgagtcacgc

SEQ ID NO: 7300 - DNA, 22 bp, Artificial Sequence
  Description of Artificial Sequence: Synthetic oligonucleotide
aggactcgctagcgagtcctgc

SEQ ID NO: 7301 - DNA, 22 bp, Artificial Sequence
  Description of Artificial Sequence: Synthetic oligonucleotide
tggactcgctagcgagtccagc

SEQ ID NO: 7302 - DNA, 22 bp, Artificial Sequence
  Description of Artificial Sequence: Synthetic oligonucleotide
aggactcgctagcgagtcctcg

SEQ ID NO: 7303 - DNA, 22 bp, Artificial Sequence
  Description of Artificial Sequence: Synthetic oligonucleotide
tggactcgctagcgagtccacg

SEQ ID NO: 7304 - DNA, 22 bp, Artificial Sequence
  Description of Artificial Sequence: Synthetic oligonucleotide
ccgactcgctagcgagtcggtg

SEQ ID NO: 7305 - DNA, 22 bp, Artificial Sequence
  Description of Artificial Sequence: Synthetic oligonucleotide
ccgactcgctagcgagtcggag

SEQ ID NO: 7306 - DNA, 22 bp, Artificial Sequence
  Description of Artificial Sequence: Synthetic oligonucleotide
gggactcgctagcgagtcccgc

SEQ ID NO: 7307 - DNA, 22 bp, Artificial Sequence
  Description of Artificial Sequence: Synthetic oligonucleotide
gggactcgctagcgagtccctc

SEQ ID NO: 7308 - DNA, 22 bp, Artificial Sequence
  Description of Artificial Sequence: Synthetic oligonucleotide
gggactcgctagcgagtcccac

SEQ ID NO: 7309 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgcgcgcgagtcnnnn

SEQ ID NO: 7310 - DNA, 22 bp, Artificial Sequence
  Description of Artificial Sequence: Synthetic oligonucleotide
cggactcgcgcgcgagtccgcc

SEQ ID NO: 7311 - DNA, 22 bp, Artificial Sequence
  Description of Artificial Sequence: Synthetic oligonucleotide
cggactcgcgcgcgagtccgct

SEQ ID NO: 7312 - DNA, 22 bp, Artificial Sequence
  Description of Artificial Sequence: Synthetic oligonucleotide
cggactcgcgcgcgagtccgtc

SEQ ID NO: 7313 - DNA, 22 bp, Artificial Sequence
  Description of Artificial Sequence: Synthetic oligonucleotide
aggactcgcgcgcgagtcctcc

SEQ ID NO: 7314 - DNA, 22 bp, Artificial Sequence
  Description of Artificial Sequence: Synthetic oligonucleotide
cagactcgcgcgcgagtctgcc

SEQ ID NO: 7315 - DNA, 22 bp, Artificial Sequence
  Description of Artificial Sequence: Synthetic oligonucleotide
cggactcgcgcgcgagtccgca

SEQ ID NO: 7316 - DNA, 22 bp, Artificial Sequence
  Description of Artificial Sequence: Synthetic oligonucleotide
cggactcgcgcgcgagtccgac

SEQ ID NO: 7317 - DNA, 22 bp, Artificial Sequence
  Description of Artificial Sequence: Synthetic oligonucleotide
tggactcgcgcgcgagtccacc

SEQ ID NO: 7318 - DNA, 22 bp, Artificial Sequence
  Description of Artificial Sequence: Synthetic oligonucleotide
ctgactcgcgcgcgagtcagcc

SEQ ID NO: 7319 - DNA, 22 bp, Artificial Sequence
  Description of Artificial Sequence: Synthetic oligonucleotide
ccgactcgcgcgcgagtcgggc

SEQ ID NO: 7320 - DNA, 22 bp, Artificial Sequence
  Description of Artificial Sequence: Synthetic oligonucleotide
ccgactcgcgcgcgagtcgggt

SEQ ID NO: 7321 - DNA, 22 bp, Artificial Sequence
  Description of Artificial Sequence: Synthetic oligonucleotide
ccgactcgcgcgcgagtcggtc

SEQ ID NO: 7322 - DNA, 22 bp, Artificial Sequence
  Description of Artificial Sequence: Synthetic oligonucleotide
acgactcgcgcgcgagtcgtgc

SEQ ID NO: 7323 - DNA, 22 bp, Artificial Sequence
  Description of Artificial Sequence: Synthetic oligonucleotide
cagactcgcgcgcgagtctggc

SEQ ID NO: 7324 - DNA, 22 bp, Artificial Sequence
  Description of Artificial Sequence: Synthetic oligonucleotide
ccgactcgcgcgcgagtcggga

SEQ ID NO: 7325 - DNA, 22 bp, Artificial Sequence
  Description of Artificial Sequence: Synthetic oligonucleotide
ccgactcgcgcgcgagtcggac

SEQ ID NO: 7326 - DNA, 22 bp, Artificial Sequence
  Description of Artificial Sequence: Synthetic oligonucleotide
ctgactcgcgcgcgagtcaggc

SEQ ID NO: 7327 - DNA, 22 bp, Artificial Sequence
  Description of Artificial Sequence: Synthetic oligonucleotide
gcgactcgcgcgcgagtcgccc

SEQ ID NO: 7328 - DNA, 22 bp, Artificial Sequence
  Description of Artificial Sequence: Synthetic oligonucleotide
gcgactcgcgcgcgagtcgcct

SEQ ID NO: 7329 - DNA, 22 bp, Artificial Sequence
  Description of Artificial Sequence: Synthetic oligonucleotide
gcgactcgcgcgcgagtcgctc

SEQ ID NO: 7330 - DNA, 22 bp, Artificial Sequence
  Description of Artificial Sequence: Synthetic oligonucleotide
acgactcgcgcgcgagtcgtcc

SEQ ID NO: 7331 - DNA, 22 bp, Artificial Sequence
  Description of Artificial Sequence: Synthetic oligonucleotide
gagactcgcgcgcgagtctccc

SEQ ID NO: 7332 - DNA, 22 bp, Artificial Sequence
  Description of Artificial Sequence: Synthetic oligonucleotide
gcgactcgcgcgcgagtcgcca

SEQ ID NO: 7333 - DNA, 22 bp, Artificial Sequence
  Description of Artificial Sequence: Synthetic oligonucleotide
gcgactcgcgcgcgagtcgcac

SEQ ID NO: 7334 - DNA, 22 bp, Artificial Sequence
  Description of Artificial Sequence: Synthetic oligonucleotide
gtgactcgcgcgcgagtcaccc

SEQ ID NO: 7335 - DNA, 22 bp, Artificial Sequence
  Description of Artificial Sequence: Synthetic oligonucleotide
gggactcgcgcgcgagtcccgt

SEQ ID NO: 7336 - DNA, 22 bp, Artificial Sequence
  Description of Artificial Sequence: Synthetic oligonucleotide
gggactcgcgcgcgagtccctg

SEQ ID NO: 7337 - DNA, 22 bp, Artificial Sequence
  Description of Artificial Sequence: Synthetic oligonucleotide
aggactcgcgcgcgagtcctgg

SEQ ID NO: 7338 - DNA, 22 bp, Artificial Sequence
  Description of Artificial Sequence: Synthetic oligonucleotide
gagactcgcgcgcgagtctcgg

SEQ ID NO: 7339 - DNA, 22 bp, Artificial Sequence
  Description of Artificial Sequence: Synthetic oligonucleotide
gggactcgcgcgcgagtcccga

SEQ ID NO: 7340 - DNA, 22 bp, Artificial Sequence
  Description of Artificial Sequence: Synthetic oligonucleotide
gggactcgcgcgcgagtcccag

SEQ ID NO: 7341 - DNA, 22 bp, Artificial Sequence
  Description of Artificial Sequence: Synthetic oligonucleotide
tggactcgcgcgcgagtccagg

SEQ ID NO: 7342 - DNA, 22 bp, Artificial Sequence
  Description of Artificial Sequence: Synthetic oligonucleotide
gtgactcgcgcgcgagtcacgg

SEQ ID NO: 7343 - DNA, 22 bp, Artificial Sequence
  Description of Artificial Sequence: Synthetic oligonucleotide
gcgactcgcgcgcgagtcgccg

SEQ ID NO: 7344 - DNA, 22 bp, Artificial Sequence
  Description of Artificial Sequence: Synthetic oligonucleotide
gcgactcgcgcgcgagtcgctg

SEQ ID NO: 7345 - DNA, 22 bp, Artificial Sequence
  Description of Artificial Sequence: Synthetic oligonucleotide
acgactcgcgcgcgagtcgtcg

SEQ ID NO: 7346 - DNA, 22 bp, Artificial Sequence
  Description of Artificial Sequence: Synthetic oligonucleotide
gagactcgcgcgcgagtctccg

SEQ ID NO: 7347 - DNA, 22 bp, Artificial Sequence
  Description of Artificial Sequence: Synthetic oligonucleotide
gcgactcgcgcgcgagtcgcag

SEQ ID NO: 7348 - DNA, 22 bp, Artificial Sequence
  Description of Artificial Sequence: Synthetic oligonucleotide
gtgactcgcgcgcgagtcaccg

SEQ ID NO: 7349 - DNA, 22 bp, Artificial Sequence
  Description of Artificial Sequence: Synthetic oligonucleotide
cggactcgcgcgcgagtccgtg

SEQ ID NO: 7350 - DNA, 22 bp, Artificial Sequence
  Description of Artificial Sequence: Synthetic oligonucleotide
cagactcgcgcgcgagtctggg

SEQ ID NO: 7351 - DNA, 22 bp, Artificial Sequence
  Description of Artificial Sequence: Synthetic oligonucleotide
cggactcgcgcgcgagtccgag

SEQ ID NO: 7352 - DNA, 22 bp, Artificial Sequence
  Description of Artificial Sequence: Synthetic oligonucleotide
ctgactcgcgcgcgagtcaggg

SEQ ID NO: 7353 - DNA, 22 bp, Artificial Sequence
  Description of Artificial Sequence: Synthetic oligonucleotide
acgactcgcgcgcgagtcgtgg

SEQ ID NO: 7354 - DNA, 22 bp, Artificial Sequence
  Description of Artificial Sequence: Synthetic oligonucleotide
ccgactcgcgcgcgagtcggct

SEQ ID NO: 7355 - DNA, 22 bp, Artificial Sequence
  Description of Artificial Sequence: Synthetic oligonucleotide
ccgactcgcgcgcgagtcggca

SEQ ID NO: 7356 - DNA, 22 bp, Artificial Sequence
  Description of Artificial Sequence: Synthetic oligonucleotide
gagactcgcgcgcgagtctcgc

SEQ ID NO: 7357 - DNA, 22 bp, Artificial Sequence
  Description of Artificial Sequence: Synthetic oligonucleotide
gtgactcgcgcgcgagtcacgc

SEQ ID NO: 7358 - DNA, 22 bp, Artificial Sequence
  Description of Artificial Sequence: Synthetic oligonucleotide
aggactcgcgcgcgagtcctgc

SEQ ID NO: 7359 - DNA, 22 bp, Artificial Sequence
  Description of Artificial Sequence: Synthetic oligonucleotide
tggactcgcgcgcgagtccagc

SEQ ID NO: 7360 - DNA, 22 bp, Artificial Sequence
  Description of Artificial Sequence: Synthetic oligonucleotide
aggactcgcgcgcgagtcctcg

SEQ ID NO: 7361 - DNA, 22 bp, Artificial Sequence
  Description of Artificial Sequence: Synthetic oligonucleotide
tggactcgcgcgcgagtccacg

SEQ ID NO: 7362 - DNA, 22 bp, Artificial Sequence
  Description of Artificial Sequence: Synthetic oligonucleotide
ccgactcgcgcgcgagtcggtg

SEQ ID NO: 7363 - DNA, 22 bp, Artificial Sequence
  Description of Artificial Sequence: Synthetic oligonucleotide
ccgactcgcgcgcgagtcggag

SEQ ID NO: 7364 - DNA, 22 bp, Artificial Sequence
  Description of Artificial Sequence: Synthetic oligonucleotide
gggactcgcgcgcgagtcccgc

SEQ ID NO: 7365 - DNA, 22 bp, Artificial Sequence
  Description of Artificial Sequence: Synthetic oligonucleotide
gggactcgcgcgcgagtccctc

SEQ ID NO: 7366 - DNA, 22 bp, Artificial Sequence
  Description of Artificial Sequence: Synthetic oligonucleotide
gggactcgcgcgcgagtcccac

SEQ ID NO: 7367 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgccggcgagtcnnnn

SEQ ID NO: 7368 - DNA, 22 bp, Artificial Sequence
  Description of Artificial Sequence: Synthetic oligonucleotide
cggactcgccggcgagtccgcc

SEQ ID NO: 7369 - DNA, 22 bp, Artificial Sequence
  Description of Artificial Sequence: Synthetic oligonucleotide
cggactcgccggcgagtccgct

SEQ ID NO: 7370 - DNA, 22 bp, Artificial Sequence
  Description of Artificial Sequence: Synthetic oligonucleotide
cggactcgccggcgagtccgtc

SEQ ID NO: 7371 - DNA, 22 bp, Artificial Sequence
  Description of Artificial Sequence: Synthetic oligonucleotide
aggactcgccggcgagtcctcc

SEQ ID NO: 7372 - DNA, 22 bp, Artificial Sequence
  Description of Artificial Sequence: Synthetic oligonucleotide
cagactcgccggcgagtctgcc

SEQ ID NO: 7373 - DNA, 22 bp, Artificial Sequence
  Description of Artificial Sequence: Synthetic oligonucleotide
cggactcgccggcgagtccgca

SEQ ID NO: 7374 - DNA, 22 bp, Artificial Sequence
  Description of Artificial Sequence: Synthetic oligonucleotide
cggactcgccggcgagtccgac

SEQ ID NO: 7375 - DNA, 22 bp, Artificial Sequence
  Description of Artificial Sequence: Synthetic oligonucleotide
tggactcgccggcgagtccacc

SEQ ID NO: 7376 - DNA, 22 bp, Artificial Sequence
  Description of Artificial Sequence: Synthetic oligonucleotide
ctgactcgccggcgagtcagcc

SEQ ID NO: 7377 - DNA, 22 bp, Artificial Sequence
  Description of Artificial Sequence: Synthetic oligonucleotide
ccgactcgccggcgagtcgggc

SEQ ID NO: 7378 - DNA, 22 bp, Artificial Sequence
  Description of Artificial Sequence: Synthetic oligonucleotide
ccgactcgccggcgagtcgggt

SEQ ID NO: 7379 - DNA, 22 bp, Artificial Sequence
  Description of Artificial Sequence: Synthetic oligonucleotide
ccgactcgccggcgagtcggtc

SEQ ID NO: 7380 - DNA, 22 bp, Artificial Sequence
  Description of Artificial Sequence: Synthetic oligonucleotide
acgactcgccggcgagtcgtgc

SEQ ID NO: 7381 - DNA, 22 bp, Artificial Sequence
  Description of Artificial Sequence: Synthetic oligonucleotide
cagactcgccggcgagtctggc

SEQ ID NO: 7382 - DNA, 22 bp, Artificial Sequence
  Description of Artificial Sequence: Synthetic oligonucleotide
ccgactcgccggcgagtcggga

SEQ ID NO: 7383 - DNA, 22 bp, Artificial Sequence
  Description of Artificial Sequence: Synthetic oligonucleotide
ccgactcgccggcgagtcggac

SEQ ID NO: 7384 - DNA, 22 bp, Artificial Sequence
  Description of Artificial Sequence: Synthetic oligonucleotide
ctgactcgccggcgagtcaggc

SEQ ID NO: 7385 - DNA, 22 bp, Artificial Sequence
  Description of Artificial Sequence: Synthetic oligonucleotide
gcgactcgccggcgagtcgccc

SEQ ID NO: 7386 - DNA, 22 bp, Artificial Sequence
  Description of Artificial Sequence: Synthetic oligonucleotide
gcgactcgccggcgagtcgcct

SEQ ID NO: 7387 - DNA, 22 bp, Artificial Sequence
  Description of Artificial Sequence: Synthetic oligonucleotide
gcgactcgccggcgagtcgctc

SEQ ID NO: 7388 - DNA, 22 bp, Artificial Sequence
  Description of Artificial Sequence: Synthetic oligonucleotide
acgactcgccggcgagtcgtcc

SEQ ID NO: 7389 - DNA, 22 bp, Artificial Sequence
  Description of Artificial Sequence: Synthetic oligonucleotide
gagactcgccggcgagtctccc

SEQ ID NO: 7390 - DNA, 22 bp, Artificial Sequence
  Description of Artificial Sequence: Synthetic oligonucleotide
gcgactcgccggcgagtcgcca

SEQ ID NO: 7391 - DNA, 22 bp, Artificial Sequence
  Description of Artificial Sequence: Synthetic oligonucleotide
gcgactcgccggcgagtcgcac

SEQ ID NO: 7392 - DNA, 22 bp, Artificial Sequence
  Description of Artificial Sequence: Synthetic oligonucleotide
gtgactcgccggcgagtcaccc

SEQ ID NO: 7393 - DNA, 22 bp, Artificial Sequence
  Description of Artificial Sequence: Synthetic oligonucleotide
gggactcgccggcgagtcccgt

SEQ ID NO: 7394 - DNA, 22 bp, Artificial Sequence
  Description of Artificial Sequence: Synthetic oligonucleotide
gggactcgccggcgagtccctg

SEQ ID NO: 7395 - DNA, 22 bp, Artificial Sequence
  Description of Artificial Sequence: Synthetic oligonucleotide
aggactcgccggcgagtcctgg

SEQ ID NO: 7396 - DNA, 22 bp, Artificial Sequence
  Description of Artificial Sequence: Synthetic oligonucleotide
gagactcgccggcgagtctcgg

SEQ ID NO: 7397 - DNA, 22 bp, Artificial Sequence
  Description of Artificial Sequence: Synthetic oligonucleotide
gggactcgccggcgagtcccga

SEQ ID NO: 7398 - DNA, 22 bp, Artificial Sequence
  Description of Artificial Sequence: Synthetic oligonucleotide
gggactcgccggcgagtcccag

SEQ ID NO: 7399 - DNA, 22 bp, Artificial Sequence
  Description of Artificial Sequence: Synthetic oligonucleotide
tggactcgccggcgagtccagg

SEQ ID NO: 7400 - DNA, 22 bp, Artificial Sequence
  Description of Artificial Sequence: Synthetic oligonucleotide
gtgactcgccggcgagtcacgg

SEQ ID NO: 7401 - DNA, 22 bp, Artificial Sequence
  Description of Artificial Sequence: Synthetic oligonucleotide
gcgactcgccggcgagtcgccg

SEQ ID NO: 7402 - DNA, 22 bp, Artificial Sequence
  Description of Artificial Sequence: Synthetic oligonucleotide
gcgactcgccggcgagtcgctg

SEQ ID NO: 7403 - DNA, 22 bp, Artificial Sequence
  Description of Artificial Sequence: Synthetic oligonucleotide
acgactcgccggcgagtcgtcg

SEQ ID NO: 7404 - DNA, 22 bp, Artificial Sequence
  Description of Artificial Sequence: Synthetic oligonucleotide
gagactcgccggcgagtctccg

SEQ ID NO: 7405 - DNA, 22 bp, Artificial Sequence
  Description of Artificial Sequence: Synthetic oligonucleotide
gcgactcgccggcgagtcgcag

SEQ ID NO: 7406 - DNA, 22 bp, Artificial Sequence
  Description of Artificial Sequence: Synthetic oligonucleotide
gtgactcgccggcgagtcaccg

SEQ ID NO: 7407 - DNA, 22 bp, Artificial Sequence
  Description of Artificial Sequence: Synthetic oligonucleotide
cggactcgccggcgagtccgtg

SEQ ID NO: 7408 - DNA, 22 bp, Artificial Sequence
  Description of Artificial Sequence: Synthetic oligonucleotide
cagactcgccggcgagtctggg

SEQ ID NO: 7409 - DNA, 22 bp, Artificial Sequence
  Description of Artificial Sequence: Synthetic oligonucleotide
cggactcgccggcgagtccgag

SEQ ID NO: 7410 - DNA, 22 bp, Artificial Sequence
  Description of Artificial Sequence: Synthetic oligonucleotide
ctgactcgccggcgagtcaggg

SEQ ID NO: 7411 - DNA, 22 bp, Artificial Sequence
  Description of Artificial Sequence: Synthetic oligonucleotide
acgactcgccggcgagtcgtgg

SEQ ID NO: 7412 - DNA, 22 bp, Artificial Sequence
  Description of Artificial Sequence: Synthetic oligonucleotide
ccgactcgccggcgagtcggct

SEQ ID NO: 7413 - DNA, 22 bp, Artificial Sequence
  Description of Artificial Sequence: Synthetic oligonucleotide
ccgactcgccggcgagtcggca

SEQ ID NO: 7414 - DNA, 22 bp, Artificial Sequence
  Description of Artificial Sequence: Synthetic oligonucleotide
gagactcgccggcgagtctcgc

SEQ ID NO: 7415 - DNA, 22 bp, Artificial Sequence
  Description of Artificial Sequence: Synthetic oligonucleotide
gtgactcgccggcgagtcacgc

SEQ ID NO: 7416 - DNA, 22 bp, Artificial Sequence
  Description of Artificial Sequence: Synthetic oligonucleotide
aggactcgccggcgagtcctgc

SEQ ID NO: 7417 - DNA, 22 bp, Artificial Sequence
  Description of Artificial Sequence: Synthetic oligonucleotide
tggactcgccggcgagtccagc

SEQ ID NO: 7418 - DNA, 22 bp, Artificial Sequence
  Description of Artificial Sequence: Synthetic oligonucleotide
aggactcgccggcgagtcctcg

SEQ ID NO: 7419 - DNA, 22 bp, Artificial Sequence
  Description of Artificial Sequence: Synthetic oligonucleotide
tggactcgccggcgagtccacg

SEQ ID NO: 7420 - DNA, 22 bp, Artificial Sequence
  Description of Artificial Sequence: Synthetic oligonucleotide
ccgactcgccggcgagtcggtg

SEQ ID NO: 7421 - DNA, 22 bp, Artificial Sequence
  Description of Artificial Sequence: Synthetic oligonucleotide
ccgactcgccggcgagtcggag

SEQ ID NO: 7422 - DNA, 22 bp, Artificial Sequence
  Description of Artificial Sequence: Synthetic oligonucleotide
gggactcgccggcgagtcccgc

SEQ ID NO: 7423 - DNA, 22 bp, Artificial Sequence
  Description of Artificial Sequence: Synthetic oligonucleotide
gggactcgccggcgagtccctc

SEQ ID NO: 7424 - DNA, 22 bp, Artificial Sequence
  Description of Artificial Sequence: Synthetic oligonucleotide
gggactcgccggcgagtcccac

SEQ ID NO: 7425 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcacatgtgagtcnnnn

SEQ ID NO: 7426 - DNA, 22 bp, Artificial Sequence
  Description of Artificial Sequence: Synthetic oligonucleotide
cggactcacatgtgagtccgcc

SEQ ID NO: 7427 - DNA, 22 bp, Artificial Sequence
  Description of Artificial Sequence: Synthetic oligonucleotide
cggactcacatgtgagtccgct

SEQ ID NO: 7428 - DNA, 22 bp, Artificial Sequence
  Description of Artificial Sequence: Synthetic oligonucleotide
cggactcacatgtgagtccgtc

SEQ ID NO: 7429 - DNA, 22 bp, Artificial Sequence
  Description of Artificial Sequence: Synthetic oligonucleotide
aggactcacatgtgagtcctcc

SEQ ID NO: 7430 - DNA, 22 bp, Artificial Sequence
  Description of Artificial Sequence: Synthetic oligonucleotide
cagactcacatgtgagtctgcc

SEQ ID NO: 7431 - DNA, 22 bp, Artificial Sequence
  Description of Artificial Sequence: Synthetic oligonucleotide
cggactcacatgtgagtccgca

SEQ ID NO: 7432 - DNA, 22 bp, Artificial Sequence
  Description of Artificial Sequence: Synthetic oligonucleotide
cggactcacatgtgagtccgac

SEQ ID NO: 7433 - DNA, 22 bp, Artificial Sequence
  Description of Artificial Sequence: Synthetic oligonucleotide
tggactcacatgtgagtccacc

SEQ ID NO: 7434 - DNA, 22 bp, Artificial Sequence
  Description of Artificial Sequence: Synthetic oligonucleotide
ctgactcacatgtgagtcagcc

SEQ ID NO: 7435 - DNA, 22 bp, Artificial Sequence
  Description of Artificial Sequence: Synthetic oligonucleotide
ccgactcacatgtgagtcgggc

SEQ ID NO: 7436 - DNA, 22 bp, Artificial Sequence
  Description of Artificial Sequence: Synthetic oligonucleotide
ccgactcacatgtgagtcgggt

SEQ ID NO: 7437 - DNA, 22 bp, Artificial Sequence
  Description of Artificial Sequence: Synthetic oligonucleotide
ccgactcacatgtgagtcggtc

SEQ ID NO: 7438 - DNA, 22 bp, Artificial Sequence
  Description of Artificial Sequence: Synthetic oligonucleotide
acgactcacatgtgagtcgtgc

SEQ ID NO: 7439 - DNA, 22 bp, Artificial Sequence
  Description of Artificial Sequence: Synthetic oligonucleotide
cagactcacatgtgagtctggc

SEQ ID NO: 7440 - DNA, 22 bp, Artificial Sequence
  Description of Artificial Sequence: Synthetic oligonucleotide
ccgactcacatgtgagtcggga

SEQ ID NO: 7441 - DNA, 22 bp, Artificial Sequence
  Description of Artificial Sequence: Synthetic oligonucleotide
ccgactcacatgtgagtcggac

SEQ ID NO: 7442 - DNA, 22 bp, Artificial Sequence
  Description of Artificial Sequence: Synthetic oligonucleotide
ctgactcacatgtgagtcaggc

SEQ ID NO: 7443 - DNA, 22 bp, Artificial Sequence
  Description of Artificial Sequence: Synthetic oligonucleotide
gcgactcacatgtgagtcgccc

SEQ ID NO: 7444 - DNA, 22 bp, Artificial Sequence
  Description of Artificial Sequence: Synthetic oligonucleotide
gcgactcacatgtgagtcgcct

SEQ ID NO: 7445 - DNA, 22 bp, Artificial Sequence
  Description of Artificial Sequence: Synthetic oligonucleotide
gcgactcacatgtgagtcgctc

SEQ ID NO: 7446 - DNA, 22 bp, Artificial Sequence
  Description of Artificial Sequence: Synthetic oligonucleotide
acgactcacatgtgagtcgtcc

SEQ ID NO: 7447 - DNA, 22 bp, Artificial Sequence
  Description of Artificial Sequence: Synthetic oligonucleotide
gagactcacatgtgagtctccc

SEQ ID NO: 7448 - DNA, 22 bp, Artificial Sequence
  Description of Artificial Sequence: Synthetic oligonucleotide
gcgactcacatgtgagtcgcca

SEQ ID NO: 7449 - DNA, 22 bp, Artificial Sequence
  Description of Artificial Sequence: Synthetic oligonucleotide
gcgactcacatgtgagtcgcac

SEQ ID NO: 7450 - DNA, 22 bp, Artificial Sequence
  Description of Artificial Sequence: Synthetic oligonucleotide
gtgactcacatgtgagtcaccc

SEQ ID NO: 7451 - DNA, 22 bp, Artificial Sequence
  Description of Artificial Sequence: Synthetic oligonucleotide
gggactcacatgtgagtcccgt

SEQ ID NO: 7452 - DNA, 22 bp, Artificial Sequence
  Description of Artificial Sequence: Synthetic oligonucleotide
gggactcacatgtgagtccctg

SEQ ID NO: 7453 - DNA, 22 bp, Artificial Sequence
  Description of Artificial Sequence: Synthetic oligonucleotide
aggactcacatgtgagtcctgg

SEQ ID NO: 7454 - DNA, 22 bp, Artificial Sequence
  Description of Artificial Sequence: Synthetic oligonucleotide
gagactcacatgtgagtctcgg

SEQ ID NO: 7455 - DNA, 22 bp, Artificial Sequence
  Description of Artificial Sequence: Synthetic oligonucleotide
gggactcacatgtgagtcccga

SEQ ID NO: 7456 - DNA, 22 bp, Artificial Sequence
  Description of Artificial Sequence: Synthetic oligonucleotide
gggactcacatgtgagtcccag

SEQ ID NO: 7457 - DNA, 22 bp, Artificial Sequence
  Description of Artificial Sequence: Synthetic oligonucleotide
tggactcacatgtgagtccagg

SEQ ID NO: 7458 - DNA, 22 bp, Artificial Sequence
  Description of Artificial Sequence: Synthetic oligonucleotide
gtgactcacatgtgagtcacgg

SEQ ID NO: 7459 - DNA, 22 bp, Artificial Sequence
  Description of Artificial Sequence: Synthetic oligonucleotide
gcgactcacatgtgagtcgccg

SEQ ID NO: 7460 - DNA, 22 bp, Artificial Sequence
  Description of Artificial Sequence: Synthetic oligonucleotide
gcgactcacatgtgagtcgctg

SEQ ID NO: 7461 - DNA, 22 bp, Artificial Sequence
  Description of Artificial Sequence: Synthetic oligonucleotide
acgactcacatgtgagtcgtcg

SEQ ID NO: 7462 - DNA, 22 bp, Artificial Sequence
  Description of Artificial Sequence: Synthetic oligonucleotide
gagactcacatgtgagtctccg

SEQ ID NO: 7463 - DNA, 22 bp, Artificial Sequence
  Description of Artificial Sequence: Synthetic oligonucleotide
gcgactcacatgtgagtcgcag

SEQ ID NO: 7464 - DNA, 22 bp, Artificial Sequence
  Description of Artificial Sequence: Synthetic oligonucleotide
gtgactcacatgtgagtcaccg

SEQ ID NO: 7465 - DNA, 22 bp, Artificial Sequence
  Description of Artificial Sequence: Synthetic oligonucleotide
cggactcacatgtgagtccgtg

SEQ ID NO: 7466 - DNA, 22 bp, Artificial Sequence
  Description of Artificial Sequence: Synthetic oligonucleotide
cagactcacatgtgagtctggg

SEQ ID NO: 7467 - DNA, 22 bp, Artificial Sequence
  Description of Artificial Sequence: Synthetic oligonucleotide
cggactcacatgtgagtccgag

SEQ ID NO: 7468 - DNA, 22 bp, Artificial Sequence
  Description of Artificial Sequence: Synthetic oligonucleotide
ctgactcacatgtgagtcaggg

SEQ ID NO: 7469 - DNA, 22 bp, Artificial Sequence
  Description of Artificial Sequence: Synthetic oligonucleotide
acgactcacatgtgagtcgtgg

SEQ ID NO: 7470 - DNA, 22 bp, Artificial Sequence
  Description of Artificial Sequence: Synthetic oligonucleotide
ccgactcacatgtgagtcggct

SEQ ID NO: 7471 - DNA, 22 bp, Artificial Sequence
  Description of Artificial Sequence: Synthetic oligonucleotide
ccgactcacatgtgagtcggca

SEQ ID NO: 7472 - DNA, 22 bp, Artificial Sequence
  Description of Artificial Sequence: Synthetic oligonucleotide
gagactcacatgtgagtctcgc

SEQ ID NO: 7473 - DNA, 22 bp, Artificial Sequence
  Description of Artificial Sequence: Synthetic oligonucleotide
gtgactcacatgtgagtcacgc

SEQ ID NO: 7474 - DNA, 22 bp, Artificial Sequence
  Description of Artificial Sequence: Synthetic oligonucleotide
aggactcacatgtgagtcctgc

SEQ ID NO: 7475 - DNA, 22 bp, Artificial Sequence
  Description of Artificial Sequence: Synthetic oligonucleotide
tggactcacatgtgagtccagc

SEQ ID NO: 7476 - DNA, 22 bp, Artificial Sequence
  Description of Artificial Sequence: Synthetic oligonucleotide
aggactcacatgtgagtcctcg

SEQ ID NO: 7477 - DNA, 22 bp, Artificial Sequence
  Description of Artificial Sequence: Synthetic oligonucleotide
tggactcacatgtgagtccacg

SEQ ID NO: 7478 - DNA, 22 bp, Artificial Sequence
  Description of Artificial Sequence: Synthetic oligonucleotide
ccgactcacatgtgagtcggtg

SEQ ID NO: 7479 - DNA, 22 bp, Artificial Sequence
  Description of Artificial Sequence: Synthetic oligonucleotide
ccgactcacatgtgagtcggag

SEQ ID NO: 7480 - DNA, 22 bp, Artificial Sequence
  Description of Artificial Sequence: Synthetic oligonucleotide
gggactcacatgtgagtcccgc

SEQ ID NO: 7481 - DNA, 22 bp, Artificial Sequence
  Description of Artificial Sequence: Synthetic oligonucleotide
gggactcacatgtgagtccctc

SEQ ID NO: 7482 - DNA, 22 bp, Artificial Sequence
  Description of Artificial Sequence: Synthetic oligonucleotide
gggactcacatgtgagtcccac

SEQ ID NO: 7483 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcactagtgagtcnnnn

SEQ ID NO: 7484 - DNA, 22 bp, Artificial Sequence
  Description of Artificial Sequence: Synthetic oligonucleotide
cggactcactagtgagtccgcc

SEQ ID NO: 7485 - DNA, 22 bp, Artificial Sequence
  Description of Artificial Sequence: Synthetic oligonucleotide
cggactcactagtgagtccgct

SEQ ID NO: 7486 - DNA, 22 bp, Artificial Sequence
  Description of Artificial Sequence: Synthetic oligonucleotide
cggactcactagtgagtccgtc

SEQ ID NO: 7487 - DNA, 22 bp, Artificial Sequence
  Description of Artificial Sequence: Synthetic oligonucleotide
aggactcactagtgagtcctcc

SEQ ID NO: 7488 - DNA, 22 bp, Artificial Sequence
  Description of Artificial Sequence: Synthetic oligonucleotide
cagactcactagtgagtctgcc

SEQ ID NO: 7489 - DNA, 22 bp, Artificial Sequence
  Description of Artificial Sequence: Synthetic oligonucleotide
cggactcactagtgagtccgca

SEQ ID NO: 7490 - DNA, 22 bp, Artificial Sequence
  Description of Artificial Sequence: Synthetic oligonucleotide
cggactcactagtgagtccgac

SEQ ID NO: 7491 - DNA, 22 bp, Artificial Sequence
  Description of Artificial Sequence: Synthetic oligonucleotide
tggactcactagtgagtccacc

SEQ ID NO: 7492 - DNA, 22 bp, Artificial Sequence
  Description of Artificial Sequence: Synthetic oligonucleotide
ctgactcactagtgagtcagcc

SEQ ID NO: 7493 - DNA, 22 bp, Artificial Sequence
  Description of Artificial Sequence: Synthetic oligonucleotide
ccgactcactagtgagtcgggc

SEQ ID NO: 7494 - DNA, 22 bp, Artificial Sequence
  Description of Artificial Sequence: Synthetic oligonucleotide
ccgactcactagtgagtcgggt

SEQ ID NO: 7495 - DNA, 22 bp, Artificial Sequence
  Description of Artificial Sequence: Synthetic oligonucleotide
ccgactcactagtgagtcggtc

SEQ ID NO: 7496 - DNA, 22 bp, Artificial Sequence
  Description of Artificial Sequence: Synthetic oligonucleotide
acgactcactagtgagtcgtgc

SEQ ID NO: 7497 - DNA, 22 bp, Artificial Sequence
  Description of Artificial Sequence: Synthetic oligonucleotide
cagactcactagtgagtctggc

SEQ ID NO: 7498 - DNA, 22 bp, Artificial Sequence
  Description of Artificial Sequence: Synthetic oligonucleotide
ccgactcactagtgagtcggga

SEQ ID NO: 7499 - DNA, 22 bp, Artificial Sequence
  Description of Artificial Sequence: Synthetic oligonucleotide
ccgactcactagtgagtcggac

SEQ ID NO: 7500 - DNA, 22 bp, Artificial Sequence
  Description of Artificial Sequence: Synthetic oligonucleotide
ctgactcactagtgagtcaggc

SEQ ID NO: 7501 - DNA, 22 bp, Artificial Sequence
  Description of Artificial Sequence: Synthetic oligonucleotide
gcgactcactagtgagtcgccc

SEQ ID NO: 7502 - DNA, 22 bp, Artificial Sequence
  Description of Artificial Sequence: Synthetic oligonucleotide
gcgactcactagtgagtcgcct

SEQ ID NO: 7503 - DNA, 22 bp, Artificial Sequence
  Description of Artificial Sequence: Synthetic oligonucleotide
gcgactcactagtgagtcgctc

SEQ ID NO: 7504 - DNA, 22 bp, Artificial Sequence
  Description of Artificial Sequence: Synthetic oligonucleotide
acgactcactagtgagtcgtcc

SEQ ID NO: 7505 - DNA, 22 bp, Artificial Sequence
  Description of Artificial Sequence: Synthetic oligonucleotide
gagactcactagtgagtctccc

SEQ ID NO: 7506 - DNA, 22 bp, Artificial Sequence
  Description of Artificial Sequence: Synthetic oligonucleotide
gcgactcactagtgagtcgcca

SEQ ID NO: 7507 - DNA, 22 bp, Artificial Sequence
  Description of Artificial Sequence: Synthetic oligonucleotide
gcgactcactagtgagtcgcac

SEQ ID NO: 7508 - DNA, 22 bp, Artificial Sequence
  Description of Artificial Sequence: Synthetic oligonucleotide
gtgactcactagtgagtcaccc

SEQ ID NO: 7509 - DNA, 22 bp, Artificial Sequence
  Description of Artificial Sequence: Synthetic oligonucleotide
gggactcactagtgagtcccgt

SEQ ID NO: 7510 - DNA, 22 bp, Artificial Sequence
  Description of Artificial Sequence: Synthetic oligonucleotide
gggactcactagtgagtccctg

SEQ ID NO: 7511 - DNA, 22 bp, Artificial Sequence
  Description of Artificial Sequence: Synthetic oligonucleotide
aggactcactagtgagtcctgg

SEQ ID NO: 7512 - DNA, 22 bp, Artificial Sequence
  Description of Artificial Sequence: Synthetic oligonucleotide
gagactcactagtgagtctcgg

SEQ ID NO: 7513 - DNA, 22 bp, Artificial Sequence
  Description of Artificial Sequence: Synthetic oligonucleotide
gggactcactagtgagtcccga

SEQ ID NO: 7514 - DNA, 22 bp, Artificial Sequence
  Description of Artificial Sequence: Synthetic oligonucleotide
gggactcactagtgagtcccag

SEQ ID NO: 7515 - DNA, 22 bp, Artificial Sequence
  Description of Artificial Sequence: Synthetic oligonucleotide
tggactcactagtgagtccagg

SEQ ID NO: 7516 - DNA, 22 bp, Artificial Sequence
  Description of Artificial Sequence: Synthetic oligonucleotide
gtgactcactagtgagtcacgg

SEQ ID NO: 7517 - DNA, 22 bp, Artificial Sequence
  Description of Artificial Sequence: Synthetic oligonucleotide
gcgactcactagtgagtcgccg

SEQ ID NO: 7518 - DNA, 22 bp, Artificial Sequence
  Description of Artificial Sequence: Synthetic oligonucleotide
gcgactcactagtgagtcgctg

SEQ ID NO: 7519 - DNA, 22 bp, Artificial Sequence
  Description of Artificial Sequence: Synthetic oligonucleotide
acgactcactagtgagtcgtcg

SEQ ID NO: 7520 - DNA, 22 bp, Artificial Sequence
  Description of Artificial Sequence: Synthetic oligonucleotide
gagactcactagtgagtctccg

SEQ ID NO: 7521 - DNA, 22 bp, Artificial Sequence
  Description of Artificial Sequence: Synthetic oligonucleotide
gcgactcactagtgagtcgcag

SEQ ID NO: 7522 - DNA, 22 bp, Artificial Sequence
  Description of Artificial Sequence: Synthetic oligonucleotide
gtgactcactagtgagtcaccg

SEQ ID NO: 7523 - DNA, 22 bp, Artificial Sequence
  Description of Artificial Sequence: Synthetic oligonucleotide
cggactcactagtgagtccgtg

SEQ ID NO: 7524 - DNA, 22 bp, Artificial Sequence
  Description of Artificial Sequence: Synthetic oligonucleotide
cagactcactagtgagtctggg

SEQ ID NO: 7525 - DNA, 22 bp, Artificial Sequence
  Description of Artificial Sequence: Synthetic oligonucleotide
cggactcactagtgagtccgag

SEQ ID NO: 7526 - DNA, 22 bp, Artificial Sequence
  Description of Artificial Sequence: Synthetic oligonucleotide
ctgactcactagtgagtcaggg

SEQ ID NO: 7527 - DNA, 22 bp, Artificial Sequence
  Description of Artificial Sequence: Synthetic oligonucleotide
acgactcactagtgagtcgtgg

SEQ ID NO: 7528 - DNA, 22 bp, Artificial Sequence
  Description of Artificial Sequence: Synthetic oligonucleotide
ccgactcactagtgagtcggct

SEQ ID NO: 7529 - DNA, 22 bp, Artificial Sequence
  Description of Artificial Sequence: Synthetic oligonucleotide
ccgactcactagtgagtcggca

SEQ ID NO: 7530 - DNA, 22 bp, Artificial Sequence
  Description of Artificial Sequence: Synthetic oligonucleotide
gagactcactagtgagtctcgc

SEQ ID NO: 7531 - DNA, 22 bp, Artificial Sequence
  Description of Artificial Sequence: Synthetic oligonucleotide
gtgactcactagtgagtcacgc

SEQ ID NO: 7532 - DNA, 22 bp, Artificial Sequence
  Description of Artificial Sequence: Synthetic oligonucleotide
aggactcactagtgagtcctgc

SEQ ID NO: 7533 - DNA, 22 bp, Artificial Sequence
  Description of Artificial Sequence: Synthetic oligonucleotide
tggactcactagtgagtccagc

SEQ ID NO: 7534 - DNA, 22 bp, Artificial Sequence
  Description of Artificial Sequence: Synthetic oligonucleotide
aggactcactagtgagtcctcg

SEQ ID NO: 7535 - DNA, 22 bp, Artificial Sequence
  Description of Artificial Sequence: Synthetic oligonucleotide
tggactcactagtgagtccacg

SEQ ID NO: 7536 - DNA, 22 bp, Artificial Sequence
  Description of Artificial Sequence: Synthetic oligonucleotide
ccgactcactagtgagtcggtg

SEQ ID NO: 7537 - DNA, 22 bp, Artificial Sequence
  Description of Artificial Sequence: Synthetic oligonucleotide
ccgactcactagtgagtcggag

SEQ ID NO: 7538 - DNA, 22 bp, Artificial Sequence
  Description of Artificial Sequence: Synthetic oligonucleotide
gggactcactagtgagtcccgc

SEQ ID NO: 7539 - DNA, 22 bp, Artificial Sequence
  Description of Artificial Sequence: Synthetic oligonucleotide
gggactcactagtgagtccctc

SEQ ID NO: 7540 - DNA, 22 bp, Artificial Sequence
  Description of Artificial Sequence: Synthetic oligonucleotide
gggactcactagtgagtcccac

SEQ ID NO: 7541 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcacgcgtgagtcnnnn

SEQ ID NO: 7542 - DNA, 22 bp, Artificial Sequence
  Description of Artificial Sequence: Synthetic oligonucleotide
cggactcacgcgtgagtccgcc

SEQ ID NO: 7543 - DNA, 22 bp, Artificial Sequence
  Description of Artificial Sequence: Synthetic oligonucleotide
cggactcacgcgtgagtccgct

SEQ ID NO: 7544 - DNA, 22 bp, Artificial Sequence
  Description of Artificial Sequence: Synthetic oligonucleotide
cggactcacgcgtgagtccgtc

SEQ ID NO: 7545 - DNA, 22 bp, Artificial Sequence
  Description of Artificial Sequence: Synthetic oligonucleotide
aggactcacgcgtgagtcctcc

SEQ ID NO: 7546 - DNA, 22 bp, Artificial Sequence
  Description of Artificial Sequence: Synthetic oligonucleotide
cagactcacgcgtgagtctgcc

SEQ ID NO: 7547 - DNA, 22 bp, Artificial Sequence
  Description of Artificial Sequence: Synthetic oligonucleotide
cggactcacgcgtgagtccgca

SEQ ID NO: 7548 - DNA, 22 bp, Artificial Sequence
  Description of Artificial Sequence: Synthetic oligonucleotide
cggactcacgcgtgagtccgac

SEQ ID NO: 7549 - DNA, 22 bp, Artificial Sequence
  Description of Artificial Sequence: Synthetic oligonucleotide
tggactcacgcgtgagtccacc

SEQ ID NO: 7550 - DNA, 22 bp, Artificial Sequence
  Description of Artificial Sequence: Synthetic oligonucleotide
ctgactcacgcgtgagtcagcc

SEQ ID NO: 7551 - DNA, 22 bp, Artificial Sequence
  Description of Artificial Sequence: Synthetic oligonucleotide
ccgactcacgcgtgagtcgggc

SEQ ID NO: 7552 - DNA, 22 bp, Artificial Sequence
  Description of Artificial Sequence: Synthetic oligonucleotide
ccgactcacgcgtgagtcgggt

SEQ ID NO: 7553 - DNA, 22 bp, Artificial Sequence
  Description of Artificial Sequence: Synthetic oligonucleotide
ccgactcacgcgtgagtcggtc

SEQ ID NO: 7554 - DNA, 22 bp, Artificial Sequence
  Description of Artificial Sequence: Synthetic oligonucleotide
acgactcacgcgtgagtcgtgc

SEQ ID NO: 7555 - DNA, 22 bp, Artificial Sequence
  Description of Artificial Sequence: Synthetic oligonucleotide
cagactcacgcgtgagtctggc

SEQ ID NO: 7556 - DNA, 22 bp, Artificial Sequence
  Description of Artificial Sequence: Synthetic oligonucleotide
ccgactcacgcgtgagtcggga

SEQ ID NO: 7557 - DNA, 22 bp, Artificial Sequence
  Description of Artificial Sequence: Synthetic oligonucleotide
ccgactcacgcgtgagtcggac

SEQ ID NO: 7558 - DNA, 22 bp, Artificial Sequence
  Description of Artificial Sequence: Synthetic oligonucleotide
ctgactcacgcgtgagtcaggc

SEQ ID NO: 7559 - DNA, 22 bp, Artificial Sequence
  Description of Artificial Sequence: Synthetic oligonucleotide
gcgactcacgcgtgagtcgccc

SEQ ID NO: 7560 - DNA, 22 bp, Artificial Sequence
  Description of Artificial Sequence: Synthetic oligonucleotide
gcgactcacgcgtgagtcgcct

SEQ ID NO: 7561 - DNA, 22 bp, Artificial Sequence
  Description of Artificial Sequence: Synthetic oligonucleotide
gcgactcacgcgtgagtcgctc

SEQ ID NO: 7562 - DNA, 22 bp, Artificial Sequence
  Description of Artificial Sequence: Synthetic oligonucleotide
acgactcacgcgtgagtcgtcc

SEQ ID NO: 7563 - DNA, 22 bp, Artificial Sequence
  Description of Artificial Sequence: Synthetic oligonucleotide
gagactcacgcgtgagtctccc

SEQ ID NO: 7564 - DNA, 22 bp, Artificial Sequence
  Description of Artificial Sequence: Synthetic oligonucleotide
gcgactcacgcgtgagtcgcca

SEQ ID NO: 7565 - DNA, 22 bp, Artificial Sequence
  Description of Artificial Sequence: Synthetic oligonucleotide
gcgactcacgcgtgagtcgcac

SEQ ID NO: 7566 - DNA, 22 bp, Artificial Sequence
  Description of Artificial Sequence: Synthetic oligonucleotide
gtgactcacgcgtgagtcaccc

SEQ ID NO: 7567 - DNA, 22 bp, Artificial Sequence
  Description of Artificial Sequence: Synthetic oligonucleotide
gggactcacgcgtgagtcccgt

SEQ ID NO: 7568 - DNA, 22 bp, Artificial Sequence
  Description of Artificial Sequence: Synthetic oligonucleotide
gggactcacgcgtgagtccctg

SEQ ID NO: 7569 - DNA, 22 bp, Artificial Sequence
  Description of Artificial Sequence: Synthetic oligonucleotide
aggactcacgcgtgagtcctgg

SEQ ID NO: 7570 - DNA, 22 bp, Artificial Sequence
  Description of Artificial Sequence: Synthetic oligonucleotide
gagactcacgcgtgagtctcgg

SEQ ID NO: 7571 - DNA, 22 bp, Artificial Sequence
  Description of Artificial Sequence: Synthetic oligonucleotide
gggactcacgcgtgagtcccga

SEQ ID NO: 7572 - DNA, 22 bp, Artificial Sequence
  Description of Artificial Sequence: Synthetic oligonucleotide
gggactcacgcgtgagtcccag

SEQ ID NO: 7573 - DNA, 22 bp, Artificial Sequence
  Description of Artificial Sequence: Synthetic oligonucleotide
tggactcacgcgtgagtccagg

SEQ ID NO: 7574 - DNA, 22 bp, Artificial Sequence
  Description of Artificial Sequence: Synthetic oligonucleotide
gtgactcacgcgtgagtcacgg

SEQ ID NO: 7575 - DNA, 22 bp, Artificial Sequence
  Description of Artificial Sequence: Synthetic oligonucleotide
gcgactcacgcgtgagtcgccg

SEQ ID NO: 7576 - DNA, 22 bp, Artificial Sequence
  Description of Artificial Sequence: Synthetic oligonucleotide
gcgactcacgcgtgagtcgctg

SEQ ID NO: 7577 - DNA, 22 bp, Artificial Sequence
  Description of Artificial Sequence: Synthetic oligonucleotide
acgactcacgcgtgagtcgtcg

SEQ ID NO: 7578 - DNA, 22 bp, Artificial Sequence
  Description of Artificial Sequence: Synthetic oligonucleotide
gagactcacgcgtgagtctccg

SEQ ID NO: 7579 - DNA, 22 bp, Artificial Sequence
  Description of Artificial Sequence: Synthetic oligonucleotide
gcgactcacgcgtgagtcgcag

SEQ ID NO: 7580 - DNA, 22 bp, Artificial Sequence
  Description of Artificial Sequence: Synthetic oligonucleotide
gtgactcacgcgtgagtcaccg

SEQ ID NO: 7581 - DNA, 22 bp, Artificial Sequence
  Description of Artificial Sequence: Synthetic oligonucleotide
cggactcacgcgtgagtccgtg

SEQ ID NO: 7582 - DNA, 22 bp, Artificial Sequence
  Description of Artificial Sequence: Synthetic oligonucleotide
cagactcacgcgtgagtctggg

SEQ ID NO: 7583 - DNA, 22 bp, Artificial Sequence
  Description of Artificial Sequence: Synthetic oligonucleotide
cggactcacgcgtgagtccgag

SEQ ID NO: 7584 - DNA, 22 bp, Artificial Sequence
  Description of Artificial Sequence: Synthetic oligonucleotide
ctgactcacgcgtgagtcaggg

SEQ ID NO: 7585 - DNA, 22 bp, Artificial Sequence
  Description of Artificial Sequence: Synthetic oligonucleotide
acgactcacgcgtgagtcgtgg

SEQ ID NO: 7586 - DNA, 22 bp, Artificial Sequence
  Description of Artificial Sequence: Synthetic oligonucleotide
ccgactcacgcgtgagtcggct

SEQ ID NO: 7587 - DNA, 22 bp, Artificial Sequence
  Description of Artificial Sequence: Synthetic oligonucleotide
ccgactcacgcgtgagtcggca

SEQ ID NO: 7588 - DNA, 22 bp, Artificial Sequence
  Description of Artificial Sequence: Synthetic oligonucleotide
gagactcacgcgtgagtctcgc

SEQ ID NO: 7589 - DNA, 22 bp, Artificial Sequence
  Description of Artificial Sequence: Synthetic oligonucleotide
gtgactcacgcgtgagtcacgc

SEQ ID NO: 7590 - DNA, 22 bp, Artificial Sequence
  Description of Artificial Sequence: Synthetic oligonucleotide
aggactcacgcgtgagtcctgc

SEQ ID NO: 7591 - DNA, 22 bp, Artificial Sequence
  Description of Artificial Sequence: Synthetic oligonucleotide
tggactcacgcgtgagtccagc

SEQ ID NO: 7592 - DNA, 22 bp, Artificial Sequence
  Description of Artificial Sequence: Synthetic oligonucleotide
aggactcacgcgtgagtcctcg

SEQ ID NO: 7593 - DNA, 22 bp, Artificial Sequence
  Description of Artificial Sequence: Synthetic oligonucleotide
tggactcacgcgtgagtccacg

SEQ ID NO: 7594 - DNA, 22 bp, Artificial Sequence
  Description of Artificial Sequence: Synthetic oligonucleotide
ccgactcacgcgtgagtcggtg

SEQ ID NO: 7595 - DNA, 22 bp, Artificial Sequence
  Description of Artificial Sequence: Synthetic oligonucleotide
ccgactcacgcgtgagtcggag

SEQ ID NO: 7596 - DNA, 22 bp, Artificial Sequence
  Description of Artificial Sequence: Synthetic oligonucleotide
gggactcacgcgtgagtcccgc

SEQ ID NO: 7597 - DNA, 22 bp, Artificial Sequence
  Description of Artificial Sequence: Synthetic oligonucleotide
gggactcacgcgtgagtccctc

SEQ ID NO: 7598 - DNA, 22 bp, Artificial Sequence
  Description of Artificial Sequence: Synthetic oligonucleotide
gggactcacgcgtgagtcccac

SEQ ID NO: 7599 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaccggtgagtcnnnn

SEQ ID NO: 7600 - DNA, 22 bp, Artificial Sequence
  Description of Artificial Sequence: Synthetic oligonucleotide
cggactcaccggtgagtccgcc

SEQ ID NO: 7601 - DNA, 22 bp, Artificial Sequence
  Description of Artificial Sequence: Synthetic oligonucleotide
cggactcaccggtgagtccgct

SEQ ID NO: 7602 - DNA, 22 bp, Artificial Sequence
  Description of Artificial Sequence: Synthetic oligonucleotide
cggactcaccggtgagtccgtc

SEQ ID NO: 7603 - DNA, 22 bp, Artificial Sequence
  Description of Artificial Sequence: Synthetic oligonucleotide
aggactcaccggtgagtcctcc

SEQ ID NO: 7604 - DNA, 22 bp, Artificial Sequence
  Description of Artificial Sequence: Synthetic oligonucleotide
cagactcaccggtgagtctgcc

SEQ ID NO: 7605 - DNA, 22 bp, Artificial Sequence
  Description of Artificial Sequence: Synthetic oligonucleotide
cggactcaccggtgagtccgca

SEQ ID NO: 7606 - DNA, 22 bp, Artificial Sequence
  Description of Artificial Sequence: Synthetic oligonucleotide
cggactcaccggtgagtccgac

SEQ ID NO: 7607 - DNA, 22 bp, Artificial Sequence
  Description of Artificial Sequence: Synthetic oligonucleotide
tggactcaccggtgagtccacc

SEQ ID NO: 7608 - DNA, 22 bp, Artificial Sequence
  Description of Artificial Sequence: Synthetic oligonucleotide
ctgactcaccggtgagtcagcc

SEQ ID NO: 7609 - DNA, 22 bp, Artificial Sequence
  Description of Artificial Sequence: Synthetic oligonucleotide
ccgactcaccggtgagtcgggc

SEQ ID NO: 7610 - DNA, 22 bp, Artificial Sequence
  Description of Artificial Sequence: Synthetic oligonucleotide
ccgactcaccggtgagtcgggt

SEQ ID NO: 7611 - DNA, 22 bp, Artificial Sequence
  Description of Artificial Sequence: Synthetic oligonucleotide
ccgactcaccggtgagtcggtc

SEQ ID NO: 7612 - DNA, 22 bp, Artificial Sequence
  Description of Artificial Sequence: Synthetic oligonucleotide
acgactcaccggtgagtcgtgc

SEQ ID NO: 7613 - DNA, 22 bp, Artificial Sequence
  Description of Artificial Sequence: Synthetic oligonucleotide
cagactcaccggtgagtctggc

SEQ ID NO: 7614 - DNA, 22 bp, Artificial Sequence
  Description of Artificial Sequence: Synthetic oligonucleotide
ccgactcaccggtgagtcggga

SEQ ID NO: 7615 - DNA, 22 bp, Artificial Sequence
  Description of Artificial Sequence: Synthetic oligonucleotide
ccgactcaccggtgagtcggac

SEQ ID NO: 7616 - DNA, 22 bp, Artificial Sequence
  Description of Artificial Sequence: Synthetic oligonucleotide
ctgactcaccggtgagtcaggc

SEQ ID NO: 7617 - DNA, 22 bp, Artificial Sequence
  Description of Artificial Sequence: Synthetic oligonucleotide
gcgactcaccggtgagtcgccc

SEQ ID NO: 7618 - DNA, 22 bp, Artificial Sequence
  Description of Artificial Sequence: Synthetic oligonucleotide
gcgactcaccggtgagtcgcct

SEQ ID NO: 7619 - DNA, 22 bp, Artificial Sequence
  Description of Artificial Sequence: Synthetic oligonucleotide
gcgactcaccggtgagtcgctc

SEQ ID NO: 7620 - DNA, 22 bp, Artificial Sequence
  Description of Artificial Sequence: Synthetic oligonucleotide
acgactcaccggtgagtcgtcc

SEQ ID NO: 7621 - DNA, 22 bp, Artificial Sequence
  Description of Artificial Sequence: Synthetic oligonucleotide
gagactcaccggtgagtctccc

SEQ ID NO: 7622 - DNA, 22 bp, Artificial Sequence
  Description of Artificial Sequence: Synthetic oligonucleotide
gcgactcaccggtgagtcgcca

SEQ ID NO: 7623 - DNA, 22 bp, Artificial Sequence
  Description of Artificial Sequence: Synthetic oligonucleotide
gcgactcaccggtgagtcgcac

SEQ ID NO: 7624 - DNA, 22 bp, Artificial Sequence
  Description of Artificial Sequence: Synthetic oligonucleotide
gtgactcaccggtgagtcaccc

SEQ ID NO: 7625 - DNA, 22 bp, Artificial Sequence
  Description of Artificial Sequence: Synthetic oligonucleotide
gggactcaccggtgagtcccgt

SEQ ID NO: 7626 - DNA, 22 bp, Artificial Sequence
  Description of Artificial Sequence: Synthetic oligonucleotide
gggactcaccggtgagtccctg

SEQ ID NO: 7627 - DNA, 22 bp, Artificial Sequence
  Description of Artificial Sequence: Synthetic oligonucleotide
aggactcaccggtgagtcctgg

SEQ ID NO: 7628 - DNA, 22 bp, Artificial Sequence
  Description of Artificial Sequence: Synthetic oligonucleotide
gagactcaccggtgagtctcgg

SEQ ID NO: 7629 - DNA, 22 bp, Artificial Sequence
  Description of Artificial Sequence: Synthetic oligonucleotide
gggactcaccggtgagtcccga

SEQ ID NO: 7630 - DNA, 22 bp, Artificial Sequence
  Description of Artificial Sequence: Synthetic oligonucleotide
gggactcaccggtgagtcccag

SEQ ID NO: 7631 - DNA, 22 bp, Artificial Sequence
  Description of Artificial Sequence: Synthetic oligonucleotide
tggactcaccggtgagtccagg

SEQ ID NO: 7632 - DNA, 22 bp, Artificial Sequence
  Description of Artificial Sequence: Synthetic oligonucleotide
gtgactcaccggtgagtcacgg

SEQ ID NO: 7633 - DNA, 22 bp, Artificial Sequence
  Description of Artificial Sequence: Synthetic oligonucleotide
gcgactcaccggtgagtcgccg

SEQ ID NO: 7634 - DNA, 22 bp, Artificial Sequence
  Description of Artificial Sequence: Synthetic oligonucleotide
gcgactcaccggtgagtcgctg

SEQ ID NO: 7635 - DNA, 22 bp, Artificial Sequence
  Description of Artificial Sequence: Synthetic oligonucleotide
acgactcaccggtgagtcgtcg

SEQ ID NO: 7636 - DNA, 22 bp, Artificial Sequence
  Description of Artificial Sequence: Synthetic oligonucleotide
gagactcaccggtgagtctccg

SEQ ID NO: 7637 - DNA, 22 bp, Artificial Sequence
  Description of Artificial Sequence: Synthetic oligonucleotide
gcgactcaccggtgagtcgcag

SEQ ID NO: 7638 - DNA, 22 bp, Artificial Sequence
  Description of Artificial Sequence: Synthetic oligonucleotide
gtgactcaccggtgagtcaccg

SEQ ID NO: 7639 - DNA, 22 bp, Artificial Sequence
  Description of Artificial Sequence: Synthetic oligonucleotide
cggactcaccggtgagtccgtg

SEQ ID NO: 7640 - DNA, 22 bp, Artificial Sequence
  Description of Artificial Sequence: Synthetic oligonucleotide
cagactcaccggtgagtctggg

SEQ ID NO: 7641 - DNA, 22 bp, Artificial Sequence
  Description of Artificial Sequence: Synthetic oligonucleotide
cggactcaccggtgagtccgag

SEQ ID NO: 7642 - DNA, 22 bp, Artificial Sequence
  Description of Artificial Sequence: Synthetic oligonucleotide
ctgactcaccggtgagtcaggg

SEQ ID NO: 7643 - DNA, 22 bp, Artificial Sequence
  Description of Artificial Sequence: Synthetic oligonucleotide
acgactcaccggtgagtcgtgg

SEQ ID NO: 7644 - DNA, 22 bp, Artificial Sequence
  Description of Artificial Sequence: Synthetic oligonucleotide
ccgactcaccggtgagtcggct

SEQ ID NO: 7645 - DNA, 22 bp, Artificial Sequence
  Description of Artificial Sequence: Synthetic oligonucleotide
ccgactcaccggtgagtcggca

SEQ ID NO: 7646 - DNA, 22 bp, Artificial Sequence
  Description of Artificial Sequence: Synthetic oligonucleotide
gagactcaccggtgagtctcgc

SEQ ID NO: 7647 - DNA, 22 bp, Artificial Sequence
  Description of Artificial Sequence: Synthetic oligonucleotide
gtgactcaccggtgagtcacgc

SEQ ID NO: 7648 - DNA, 22 bp, Artificial Sequence
  Description of Artificial Sequence: Synthetic oligonucleotide
aggactcaccggtgagtcctgc

SEQ ID NO: 7649 - DNA, 22 bp, Artificial Sequence
  Description of Artificial Sequence: Synthetic oligonucleotide
tggactcaccggtgagtccagc

SEQ ID NO: 7650 - DNA, 22 bp, Artificial Sequence
  Description of Artificial Sequence: Synthetic oligonucleotide
aggactcaccggtgagtcctcg

SEQ ID NO: 7651 - DNA, 22 bp, Artificial Sequence
  Description of Artificial Sequence: Synthetic oligonucleotide
tggactcaccggtgagtccacg

SEQ ID NO: 7652 - DNA, 22 bp, Artificial Sequence
  Description of Artificial Sequence: Synthetic oligonucleotide
ccgactcaccggtgagtcggtg

SEQ ID NO: 7653 - DNA, 22 bp, Artificial Sequence
  Description of Artificial Sequence: Synthetic oligonucleotide
ccgactcaccggtgagtcggag

SEQ ID NO: 7654 - DNA, 22 bp, Artificial Sequence
  Description of Artificial Sequence: Synthetic oligonucleotide
gggactcaccggtgagtcccgc

SEQ ID NO: 7655 - DNA, 22 bp, Artificial Sequence
  Description of Artificial Sequence: Synthetic oligonucleotide
gggactcaccggtgagtccctc

SEQ ID NO: 7656 - DNA, 22 bp, Artificial Sequence
  Description of Artificial Sequence: Synthetic oligonucleotide
gggactcaccggtgagtcccac

SEQ ID NO: 7657 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcggatccgagtcnnnn

SEQ ID NO: 7658 - DNA, 22 bp, Artificial Sequence
  Description of Artificial Sequence: Synthetic oligonucleotide
cggactcggatccgagtccgcc

SEQ ID NO: 7659 - DNA, 22 bp, Artificial Sequence
  Description of Artificial Sequence: Synthetic oligonucleotide
cggactcggatccgagtccgct

SEQ ID NO: 7660 - DNA, 22 bp, Artificial Sequence
  Description of Artificial Sequence: Synthetic oligonucleotide
cggactcggatccgagtccgtc

SEQ ID NO: 7661 - DNA, 22 bp, Artificial Sequence
  Description of Artificial Sequence: Synthetic oligonucleotide
aggactcggatccgagtcctcc

SEQ ID NO: 7662 - DNA, 22 bp, Artificial Sequence
  Description of Artificial Sequence: Synthetic oligonucleotide
cagactcggatccgagtctgcc

SEQ ID NO: 7663 - DNA, 22 bp, Artificial Sequence
  Description of Artificial Sequence: Synthetic oligonucleotide
cggactcggatccgagtccgca

SEQ ID NO: 7664 - DNA, 22 bp, Artificial Sequence
  Description of Artificial Sequence: Synthetic oligonucleotide
cggactcggatccgagtccgac

SEQ ID NO: 7665 - DNA, 22 bp, Artificial Sequence
  Description of Artificial Sequence: Synthetic oligonucleotide
tggactcggatccgagtccacc

SEQ ID NO: 7666 - DNA, 22 bp, Artificial Sequence
  Description of Artificial Sequence: Synthetic oligonucleotide
ctgactcggatccgagtcagcc

SEQ ID NO: 7667 - DNA, 22 bp, Artificial Sequence
  Description of Artificial Sequence: Synthetic oligonucleotide
ccgactcggatccgagtcgggc

SEQ ID NO: 7668 - DNA, 22 bp, Artificial Sequence
  Description of Artificial Sequence: Synthetic oligonucleotide
ccgactcggatccgagtcgggt

SEQ ID NO: 7669 - DNA, 22 bp, Artificial Sequence
  Description of Artificial Sequence: Synthetic oligonucleotide
ccgactcggatccgagtcggtc

SEQ ID NO: 7670 - DNA, 22 bp, Artificial Sequence
  Description of Artificial Sequence: Synthetic oligonucleotide
acgactcggatccgagtcgtgc

SEQ ID NO: 7671 - DNA, 22 bp, Artificial Sequence
  Description of Artificial Sequence: Synthetic oligonucleotide
cagactcggatccgagtctggc

SEQ ID NO: 7672 - DNA, 22 bp, Artificial Sequence
  Description of Artificial Sequence: Synthetic oligonucleotide
ccgactcggatccgagtcggga

SEQ ID NO: 7673 - DNA, 22 bp, Artificial Sequence
  Description of Artificial Sequence: Synthetic oligonucleotide
ccgactcggatccgagtcggac

SEQ ID NO: 7674 - DNA, 22 bp, Artificial Sequence
  Description of Artificial Sequence: Synthetic oligonucleotide
ctgactcggatccgagtcaggc

SEQ ID NO: 7675 - DNA, 22 bp, Artificial Sequence
  Description of Artificial Sequence: Synthetic oligonucleotide
gcgactcggatccgagtcgccc

SEQ ID NO: 7676 - DNA, 22 bp, Artificial Sequence
  Description of Artificial Sequence: Synthetic oligonucleotide
gcgactcggatccgagtcgcct

SEQ ID NO: 7677 - DNA, 22 bp, Artificial Sequence
  Description of Artificial Sequence: Synthetic oligonucleotide
gcgactcggatccgagtcgctc

SEQ ID NO: 7678 - DNA, 22 bp, Artificial Sequence
  Description of Artificial Sequence: Synthetic oligonucleotide
acgactcggatccgagtcgtcc

SEQ ID NO: 7679 - DNA, 22 bp, Artificial Sequence
  Description of Artificial Sequence: Synthetic oligonucleotide
gagactcggatccgagtctccc

SEQ ID NO: 7680 - DNA, 22 bp, Artificial Sequence
  Description of Artificial Sequence: Synthetic oligonucleotide
gcgactcggatccgagtcgcca

SEQ ID NO: 7681 - DNA, 22 bp, Artificial Sequence
  Description of Artificial Sequence: Synthetic oligonucleotide
gcgactcggatccgagtcgcac

SEQ ID NO: 7682 - DNA, 22 bp, Artificial Sequence
  Description of Artificial Sequence: Synthetic oligonucleotide
gtgactcggatccgagtcaccc

SEQ ID NO: 7683 - DNA, 22 bp, Artificial Sequence
  Description of Artificial Sequence: Synthetic oligonucleotide
gggactcggatccgagtcccgt

SEQ ID NO: 7684 - DNA, 22 bp, Artificial Sequence
  Description of Artificial Sequence: Synthetic oligonucleotide
gggactcggatccgagtccctg

SEQ ID NO: 7685 - DNA, 22 bp, Artificial Sequence
  Description of Artificial Sequence: Synthetic oligonucleotide
aggactcggatccgagtcctgg

SEQ ID NO: 7686 - DNA, 22 bp, Artificial Sequence
  Description of Artificial Sequence: Synthetic oligonucleotide
gagactcggatccgagtctcgg

SEQ ID NO: 7687 - DNA, 22 bp, Artificial Sequence
  Description of Artificial Sequence: Synthetic oligonucleotide
gggactcggatccgagtcccga

SEQ ID NO: 7688 - DNA, 22 bp, Artificial Sequence
  Description of Artificial Sequence: Synthetic oligonucleotide
gggactcggatccgagtcccag

SEQ ID NO: 7689 - DNA, 22 bp, Artificial Sequence
  Description of Artificial Sequence: Synthetic oligonucleotide
tggactcggatccgagtccagg

SEQ ID NO: 7690 - DNA, 22 bp, Artificial Sequence
  Description of Artificial Sequence: Synthetic oligonucleotide
gtgactcggatccgagtcacgg

SEQ ID NO: 7691 - DNA, 22 bp, Artificial Sequence
  Description of Artificial Sequence: Synthetic oligonucleotide
gcgactcggatccgagtcgccg

SEQ ID NO: 7692 - DNA, 22 bp, Artificial Sequence
  Description of Artificial Sequence: Synthetic oligonucleotide
gcgactcggatccgagtcgctg

SEQ ID NO: 7693 - DNA, 22 bp, Artificial Sequence
  Description of Artificial Sequence: Synthetic oligonucleotide
acgactcggatccgagtcgtcg

SEQ ID NO: 7694 - DNA, 22 bp, Artificial Sequence
  Description of Artificial Sequence: Synthetic oligonucleotide
gagactcggatccgagtctccg

SEQ ID NO: 7695 - DNA, 22 bp, Artificial Sequence
  Description of Artificial Sequence: Synthetic oligonucleotide
gcgactcggatccgagtcgcag

SEQ ID NO: 7696 - DNA, 22 bp, Artificial Sequence
  Description of Artificial Sequence: Synthetic oligonucleotide
gtgactcggatccgagtcaccg

SEQ ID NO: 7697 - DNA, 22 bp, Artificial Sequence
  Description of Artificial Sequence: Synthetic oligonucleotide
cggactcggatccgagtccgtg

SEQ ID NO: 7698 - DNA, 22 bp, Artificial Sequence
  Description of Artificial Sequence: Synthetic oligonucleotide
cagactcggatccgagtctggg

SEQ ID NO: 7699 - DNA, 22 bp, Artificial Sequence
  Description of Artificial Sequence: Synthetic oligonucleotide
cggactcggatccgagtccgag

SEQ ID NO: 7700 - DNA, 22 bp, Artificial Sequence
  Description of Artificial Sequence: Synthetic oligonucleotide
ctgactcggatccgagtcaggg

SEQ ID NO: 7701 - DNA, 22 bp, Artificial Sequence
  Description of Artificial Sequence: Synthetic oligonucleotide
acgactcggatccgagtcgtgg

SEQ ID NO: 7702 - DNA, 22 bp, Artificial Sequence
  Description of Artificial Sequence: Synthetic oligonucleotide
ccgactcggatccgagtcggct

SEQ ID NO: 7703 - DNA, 22 bp, Artificial Sequence
  Description of Artificial Sequence: Synthetic oligonucleotide
ccgactcggatccgagtcggca

SEQ ID NO: 7704 - DNA, 22 bp, Artificial Sequence
  Description of Artificial Sequence: Synthetic oligonucleotide
gagactcggatccgagtctcgc

SEQ ID NO: 7705 - DNA, 22 bp, Artificial Sequence
  Description of Artificial Sequence: Synthetic oligonucleotide
gtgactcggatccgagtcacgc

SEQ ID NO: 7706 - DNA, 22 bp, Artificial Sequence
  Description of Artificial Sequence: Synthetic oligonucleotide
aggactcggatccgagtcctgc

SEQ ID NO: 7707 - DNA, 22 bp, Artificial Sequence
  Description of Artificial Sequence: Synthetic oligonucleotide
tggactcggatccgagtccagc

SEQ ID NO: 7708 - DNA, 22 bp, Artificial Sequence
  Description of Artificial Sequence: Synthetic oligonucleotide
aggactcggatccgagtcctcg

SEQ ID NO: 7709 - DNA, 22 bp, Artificial Sequence
  Description of Artificial Sequence: Synthetic oligonucleotide
tggactcggatccgagtccacg

SEQ ID NO: 7710 - DNA, 22 bp, Artificial Sequence
  Description of Artificial Sequence: Synthetic oligonucleotide
ccgactcggatccgagtcggtg

SEQ ID NO: 7711 - DNA, 22 bp, Artificial Sequence
  Description of Artificial Sequence: Synthetic oligonucleotide
ccgactcggatccgagtcggag

SEQ ID NO: 7712 - DNA, 22 bp, Artificial Sequence
  Description of Artificial Sequence: Synthetic oligonucleotide
gggactcggatccgagtcccgc

SEQ ID NO: 7713 - DNA, 22 bp, Artificial Sequence
  Description of Artificial Sequence: Synthetic oligonucleotide
gggactcggatccgagtccctc

SEQ ID NO: 7714 - DNA, 22 bp, Artificial Sequence
  Description of Artificial Sequence: Synthetic oligonucleotide
gggactcggatccgagtcccac

SEQ ID NO: 7715 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcggtaccgagtcnnnn

SEQ ID NO: 7716 - DNA, 22 bp, Artificial Sequence
  Description of Artificial Sequence: Synthetic oligonucleotide
cggactcggtaccgagtccgcc

SEQ ID NO: 7717 - DNA, 22 bp, Artificial Sequence
  Description of Artificial Sequence: Synthetic oligonucleotide
cggactcggtaccgagtccgct

SEQ ID NO: 7718 - DNA, 22 bp, Artificial Sequence
  Description of Artificial Sequence: Synthetic oligonucleotide
cggactcggtaccgagtccgtc

SEQ ID NO: 7719 - DNA, 22 bp, Artificial Sequence
  Description of Artificial Sequence: Synthetic oligonucleotide
aggactcggtaccgagtcctcc

SEQ ID NO: 7720 - DNA, 22 bp, Artificial Sequence
  Description of Artificial Sequence: Synthetic oligonucleotide
cagactcggtaccgagtctgcc

SEQ ID NO: 7721 - DNA, 22 bp, Artificial Sequence
  Description of Artificial Sequence: Synthetic oligonucleotide
cggactcggtaccgagtccgca

SEQ ID NO: 7722 - DNA, 22 bp, Artificial Sequence
  Description of Artificial Sequence: Synthetic oligonucleotide
cggactcggtaccgagtccgac

SEQ ID NO: 7723 - DNA, 22 bp, Artificial Sequence
  Description of Artificial Sequence: Synthetic oligonucleotide
tggactcggtaccgagtccacc

SEQ ID NO: 7724 - DNA, 22 bp, Artificial Sequence
  Description of Artificial Sequence: Synthetic oligonucleotide
ctgactcggtaccgagtcagcc

SEQ ID NO: 7725 - DNA, 22 bp, Artificial Sequence
  Description of Artificial Sequence: Synthetic oligonucleotide
ccgactcggtaccgagtcgggc

SEQ ID NO: 7726 - DNA, 22 bp, Artificial Sequence
  Description of Artificial Sequence: Synthetic oligonucleotide
ccgactcggtaccgagtcgggt

SEQ ID NO: 7727 - DNA, 22 bp, Artificial Sequence
  Description of Artificial Sequence: Synthetic oligonucleotide
ccgactcggtaccgagtcggtc

SEQ ID NO: 7728 - DNA, 22 bp, Artificial Sequence
  Description of Artificial Sequence: Synthetic oligonucleotide
acgactcggtaccgagtcgtgc

SEQ ID NO: 7729 - DNA, 22 bp, Artificial Sequence
  Description of Artificial Sequence: Synthetic oligonucleotide
cagactcggtaccgagtctggc

SEQ ID NO: 7730 - DNA, 22 bp, Artificial Sequence
  Description of Artificial Sequence: Synthetic oligonucleotide
ccgactcggtaccgagtcggga

SEQ ID NO: 7731 - DNA, 22 bp, Artificial Sequence
  Description of Artificial Sequence: Synthetic oligonucleotide
ccgactcggtaccgagtcggac

SEQ ID NO: 7732 - DNA, 22 bp, Artificial Sequence
  Description of Artificial Sequence: Synthetic oligonucleotide
ctgactcggtaccgagtcaggc

SEQ ID NO: 7733 - DNA, 22 bp, Artificial Sequence
  Description of Artificial Sequence: Synthetic oligonucleotide
gcgactcggtaccgagtcgccc

SEQ ID NO: 7734 - DNA, 22 bp, Artificial Sequence
  Description of Artificial Sequence: Synthetic oligonucleotide
gcgactcggtaccgagtcgcct

SEQ ID NO: 7735 - DNA, 22 bp, Artificial Sequence
  Description of Artificial Sequence: Synthetic oligonucleotide
gcgactcggtaccgagtcgctc

SEQ ID NO: 7736 - DNA, 22 bp, Artificial Sequence
  Description of Artificial Sequence: Synthetic oligonucleotide
acgactcggtaccgagtcgtcc

SEQ ID NO: 7737 - DNA, 22 bp, Artificial Sequence
  Description of Artificial Sequence: Synthetic oligonucleotide
gagactcggtaccgagtctccc

SEQ ID NO: 7738 - DNA, 22 bp, Artificial Sequence
  Description of Artificial Sequence: Synthetic oligonucleotide
gcgactcggtaccgagtcgcca

SEQ ID NO: 7739 - DNA, 22 bp, Artificial Sequence
  Description of Artificial Sequence: Synthetic oligonucleotide
gcgactcggtaccgagtcgcac

SEQ ID NO: 7740 - DNA, 22 bp, Artificial Sequence
  Description of Artificial Sequence: Synthetic oligonucleotide
gtgactcggtaccgagtcaccc

SEQ ID NO: 7741 - DNA, 22 bp, Artificial Sequence
  Description of Artificial Sequence: Synthetic oligonucleotide
gggactcggtaccgagtcccgt

SEQ ID NO: 7742 - DNA, 22 bp, Artificial Sequence
  Description of Artificial Sequence: Synthetic oligonucleotide
gggactcggtaccgagtccctg

SEQ ID NO: 7743 - DNA, 22 bp, Artificial Sequence
  Description of Artificial Sequence: Synthetic oligonucleotide
aggactcggtaccgagtcctgg

SEQ ID NO: 7744 - DNA, 22 bp, Artificial Sequence
  Description of Artificial Sequence: Synthetic oligonucleotide
gagactcggtaccgagtctcgg

SEQ ID NO: 7745 - DNA, 22 bp, Artificial Sequence
  Description of Artificial Sequence: Synthetic oligonucleotide
gggactcggtaccgagtcccga

SEQ ID NO: 7746 - DNA, 22 bp, Artificial Sequence
  Description of Artificial Sequence: Synthetic oligonucleotide
gggactcggtaccgagtcccag

SEQ ID NO: 7747 - DNA, 22 bp, Artificial Sequence
  Description of Artificial Sequence: Synthetic oligonucleotide
tggactcggtaccgagtccagg

SEQ ID NO: 7748 - DNA, 22 bp, Artificial Sequence
  Description of Artificial Sequence: Synthetic oligonucleotide
gtgactcggtaccgagtcacgg

SEQ ID NO: 7749 - DNA, 22 bp, Artificial Sequence
  Description of Artificial Sequence: Synthetic oligonucleotide
gcgactcggtaccgagtcgccg

SEQ ID NO: 7750 - DNA, 22 bp, Artificial Sequence
  Description of Artificial Sequence: Synthetic oligonucleotide
gcgactcggtaccgagtcgctg

SEQ ID NO: 7751 - DNA, 22 bp, Artificial Sequence
  Description of Artificial Sequence: Synthetic oligonucleotide
acgactcggtaccgagtcgtcg

SEQ ID NO: 7752 - DNA, 22 bp, Artificial Sequence
  Description of Artificial Sequence: Synthetic oligonucleotide
gagactcggtaccgagtctccg

SEQ ID NO: 7753 - DNA, 22 bp, Artificial Sequence
  Description of Artificial Sequence: Synthetic oligonucleotide
gcgactcggtaccgagtcgcag

SEQ ID NO: 7754 - DNA, 22 bp, Artificial Sequence
  Description of Artificial Sequence: Synthetic oligonucleotide
gtgactcggtaccgagtcaccg

SEQ ID NO: 7755 - DNA, 22 bp, Artificial Sequence
  Description of Artificial Sequence: Synthetic oligonucleotide
cggactcggtaccgagtccgtg

SEQ ID NO: 7756 - DNA, 22 bp, Artificial Sequence
  Description of Artificial Sequence: Synthetic oligonucleotide
cagactcggtaccgagtctggg

SEQ ID NO: 7757 - DNA, 22 bp, Artificial Sequence
  Description of Artificial Sequence: Synthetic oligonucleotide
cggactcggtaccgagtccgag

SEQ ID NO: 7758 - DNA, 22 bp, Artificial Sequence
  Description of Artificial Sequence: Synthetic oligonucleotide
ctgactcggtaccgagtcaggg

SEQ ID NO: 7759 - DNA, 22 bp, Artificial Sequence
  Description of Artificial Sequence: Synthetic oligonucleotide
acgactcggtaccgagtcgtgg

SEQ ID NO: 7760 - DNA, 22 bp, Artificial Sequence
  Description of Artificial Sequence: Synthetic oligonucleotide
ccgactcggtaccgagtcggct

SEQ ID NO: 7761 - DNA, 22 bp, Artificial Sequence
  Description of Artificial Sequence: Synthetic oligonucleotide
ccgactcggtaccgagtcggca

SEQ ID NO: 7762 - DNA, 22 bp, Artificial Sequence
  Description of Artificial Sequence: Synthetic oligonucleotide
gagactcggtaccgagtctcgc

SEQ ID NO: 7763 - DNA, 22 bp, Artificial Sequence
  Description of Artificial Sequence: Synthetic oligonucleotide
gtgactcggtaccgagtcacgc

SEQ ID NO: 7764 - DNA, 22 bp, Artificial Sequence
  Description of Artificial Sequence: Synthetic oligonucleotide
aggactcggtaccgagtcctgc

SEQ ID NO: 7765 - DNA, 22 bp, Artificial Sequence
  Description of Artificial Sequence: Synthetic oligonucleotide
tggactcggtaccgagtccagc

SEQ ID NO: 7766 - DNA, 22 bp, Artificial Sequence
  Description of Artificial Sequence: Synthetic oligonucleotide
aggactcggtaccgagtcctcg

SEQ ID NO: 7767 - DNA, 22 bp, Artificial Sequence
  Description of Artificial Sequence: Synthetic oligonucleotide
tggactcggtaccgagtccacg

SEQ ID NO: 7768 - DNA, 22 bp, Artificial Sequence
  Description of Artificial Sequence: Synthetic oligonucleotide
ccgactcggtaccgagtcggtg

SEQ ID NO: 7769 - DNA, 22 bp, Artificial Sequence
  Description of Artificial Sequence: Synthetic oligonucleotide
ccgactcggtaccgagtcggag

SEQ ID NO: 7770 - DNA, 22 bp, Artificial Sequence
  Description of Artificial Sequence: Synthetic oligonucleotide
gggactcggtaccgagtcccgc

SEQ ID NO: 7771 - DNA, 22 bp, Artificial Sequence
  Description of Artificial Sequence: Synthetic oligonucleotide
gggactcggtaccgagtccctc

SEQ ID NO: 7772 - DNA, 22 bp, Artificial Sequence
  Description of Artificial Sequence: Synthetic oligonucleotide
gggactcggtaccgagtcccac

SEQ ID NO: 7773 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgggcccgagtcnnnn

SEQ ID NO: 7774 - DNA, 22 bp, Artificial Sequence
  Description of Artificial Sequence: Synthetic oligonucleotide
cggactcgggcccgagtccgcc

SEQ ID NO: 7775 - DNA, 22 bp, Artificial Sequence
  Description of Artificial Sequence: Synthetic oligonucleotide
cggactcgggcccgagtccgct

SEQ ID NO: 7776 - DNA, 22 bp, Artificial Sequence
  Description of Artificial Sequence: Synthetic oligonucleotide
cggactcgggcccgagtccgtc

SEQ ID NO: 7777 - DNA, 22 bp, Artificial Sequence
  Description of Artificial Sequence: Synthetic oligonucleotide
aggactcgggcccgagtcctcc

SEQ ID NO: 7778 - DNA, 22 bp, Artificial Sequence
  Description of Artificial Sequence: Synthetic oligonucleotide
cagactcgggcccgagtctgcc

SEQ ID NO: 7779 - DNA, 22 bp, Artificial Sequence
  Description of Artificial Sequence: Synthetic oligonucleotide
cggactcgggcccgagtccgca

SEQ ID NO: 7780 - DNA, 22 bp, Artificial Sequence
  Description of Artificial Sequence: Synthetic oligonucleotide
cggactcgggcccgagtccgac

SEQ ID NO: 7781 - DNA, 22 bp, Artificial Sequence
  Description of Artificial Sequence: Synthetic oligonucleotide
tggactcgggcccgagtccacc

SEQ ID NO: 7782 - DNA, 22 bp, Artificial Sequence
  Description of Artificial Sequence: Synthetic oligonucleotide
ctgactcgggcccgagtcagcc

SEQ ID NO: 7783 - DNA, 22 bp, Artificial Sequence
  Description of Artificial Sequence: Synthetic oligonucleotide
ccgactcgggcccgagtcgggc

SEQ ID NO: 7784 - DNA, 22 bp, Artificial Sequence
  Description of Artificial Sequence: Synthetic oligonucleotide
ccgactcgggcccgagtcgggt

SEQ ID NO: 7785 - DNA, 22 bp, Artificial Sequence
  Description of Artificial Sequence: Synthetic oligonucleotide
ccgactcgggcccgagtcggtc

SEQ ID NO: 7786 - DNA, 22 bp, Artificial Sequence
  Description of Artificial Sequence: Synthetic oligonucleotide
acgactcgggcccgagtcgtgc

SEQ ID NO: 7787 - DNA, 22 bp, Artificial Sequence
  Description of Artificial Sequence: Synthetic oligonucleotide
cagactcgggcccgagtctggc

SEQ ID NO: 7788 - DNA, 22 bp, Artificial Sequence
  Description of Artificial Sequence: Synthetic oligonucleotide
ccgactcgggcccgagtcggga

SEQ ID NO: 7789 - DNA, 22 bp, Artificial Sequence
  Description of Artificial Sequence: Synthetic oligonucleotide
ccgactcgggcccgagtcggac

SEQ ID NO: 7790 - DNA, 22 bp, Artificial Sequence
  Description of Artificial Sequence: Synthetic oligonucleotide
ctgactcgggcccgagtcaggc

SEQ ID NO: 7791 - DNA, 22 bp, Artificial Sequence
  Description of Artificial Sequence: Synthetic oligonucleotide
gcgactcgggcccgagtcgccc

SEQ ID NO: 7792 - DNA, 22 bp, Artificial Sequence
  Description of Artificial Sequence: Synthetic oligonucleotide
gcgactcgggcccgagtcgcct

SEQ ID NO: 7793 - DNA, 22 bp, Artificial Sequence
  Description of Artificial Sequence: Synthetic oligonucleotide
gcgactcgggcccgagtcgctc

SEQ ID NO: 7794 - DNA, 22 bp, Artificial Sequence
  Description of Artificial Sequence: Synthetic oligonucleotide
acgactcgggcccgagtcgtcc

SEQ ID NO: 7795 - DNA, 22 bp, Artificial Sequence
  Description of Artificial Sequence: Synthetic oligonucleotide
gagactcgggcccgagtctccc

SEQ ID NO: 7796 - DNA, 22 bp, Artificial Sequence
  Description of Artificial Sequence: Synthetic oligonucleotide
gcgactcgggcccgagtcgcca

SEQ ID NO: 7797 - DNA, 22 bp, Artificial Sequence
  Description of Artificial Sequence: Synthetic oligonucleotide
gcgactcgggcccgagtcgcac

SEQ ID NO: 7798 - DNA, 22 bp, Artificial Sequence
  Description of Artificial Sequence: Synthetic oligonucleotide
gtgactcgggcccgagtcaccc

SEQ ID NO: 7799 - DNA, 22 bp, Artificial Sequence
  Description of Artificial Sequence: Synthetic oligonucleotide
gggactcgggcccgagtcccgt

SEQ ID NO: 7800 - DNA, 22 bp, Artificial Sequence
  Description of Artificial Sequence: Synthetic oligonucleotide
gggactcgggcccgagtccctg

SEQ ID NO: 7801 - DNA, 22 bp, Artificial Sequence
  Description of Artificial Sequence: Synthetic oligonucleotide
aggactcgggcccgagtcctgg

SEQ ID NO: 7802 - DNA, 22 bp, Artificial Sequence
  Description of Artificial Sequence: Synthetic oligonucleotide
gagactcgggcccgagtctcgg

SEQ ID NO: 7803 - DNA, 22 bp, Artificial Sequence
  Description of Artificial Sequence: Synthetic oligonucleotide
gggactcgggcccgagtcccga

SEQ ID NO: 7804 - DNA, 22 bp, Artificial Sequence
  Description of Artificial Sequence: Synthetic oligonucleotide
gggactcgggcccgagtcccag

SEQ ID NO: 7805 - DNA, 22 bp, Artificial Sequence
  Description of Artificial Sequence: Synthetic oligonucleotide
tggactcgggcccgagtccagg

SEQ ID NO: 7806 - DNA, 22 bp, Artificial Sequence
  Description of Artificial Sequence: Synthetic oligonucleotide
gtgactcgggcccgagtcacgg

SEQ ID NO: 7807 - DNA, 22 bp, Artificial Sequence
  Description of Artificial Sequence: Synthetic oligonucleotide
gcgactcgggcccgagtcgccg

SEQ ID NO: 7808 - DNA, 22 bp, Artificial Sequence
  Description of Artificial Sequence: Synthetic oligonucleotide
gcgactcgggcccgagtcgctg

SEQ ID NO: 7809 - DNA, 22 bp, Artificial Sequence
  Description of Artificial Sequence: Synthetic oligonucleotide
acgactcgggcccgagtcgtcg

SEQ ID NO: 7810 - DNA, 22 bp, Artificial Sequence
  Description of Artificial Sequence: Synthetic oligonucleotide
gagactcgggcccgagtctccg

SEQ ID NO: 7811 - DNA, 22 bp, Artificial Sequence
  Description of Artificial Sequence: Synthetic oligonucleotide
gcgactcgggcccgagtcgcag

SEQ ID NO: 7812 - DNA, 22 bp, Artificial Sequence
  Description of Artificial Sequence: Synthetic oligonucleotide
gtgactcgggcccgagtcaccg

SEQ ID NO: 7813 - DNA, 22 bp, Artificial Sequence
  Description of Artificial Sequence: Synthetic oligonucleotide
cggactcgggcccgagtccgtg

SEQ ID NO: 7814 - DNA, 22 bp, Artificial Sequence
  Description of Artificial Sequence: Synthetic oligonucleotide
cagactcgggcccgagtctggg

SEQ ID NO: 7815 - DNA, 22 bp, Artificial Sequence
  Description of Artificial Sequence: Synthetic oligonucleotide
cggactcgggcccgagtccgag

SEQ ID NO: 7816 - DNA, 22 bp, Artificial Sequence
  Description of Artificial Sequence: Synthetic oligonucleotide
ctgactcgggcccgagtcaggg

SEQ ID NO: 7817 - DNA, 22 bp, Artificial Sequence
  Description of Artificial Sequence: Synthetic oligonucleotide
acgactcgggcccgagtcgtgg

SEQ ID NO: 7818 - DNA, 22 bp, Artificial Sequence
  Description of Artificial Sequence: Synthetic oligonucleotide
ccgactcgggcccgagtcggct

SEQ ID NO: 7819 - DNA, 22 bp, Artificial Sequence
  Description of Artificial Sequence: Synthetic oligonucleotide
ccgactcgggcccgagtcggca

SEQ ID NO: 7820 - DNA, 22 bp, Artificial Sequence
  Description of Artificial Sequence: Synthetic oligonucleotide
gagactcgggcccgagtctcgc

SEQ ID NO: 7821 - DNA, 22 bp, Artificial Sequence
  Description of Artificial Sequence: Synthetic oligonucleotide
gtgactcgggcccgagtcacgc

SEQ ID NO: 7822 - DNA, 22 bp, Artificial Sequence
  Description of Artificial Sequence: Synthetic oligonucleotide
aggactcgggcccgagtcctgc

SEQ ID NO: 7823 - DNA, 22 bp, Artificial Sequence
  Description of Artificial Sequence: Synthetic oligonucleotide
tggactcgggcccgagtccagc

SEQ ID NO: 7824 - DNA, 22 bp, Artificial Sequence
  Description of Artificial Sequence: Synthetic oligonucleotide
aggactcgggcccgagtcctcg

SEQ ID NO: 7825 - DNA, 22 bp, Artificial Sequence
  Description of Artificial Sequence: Synthetic oligonucleotide
tggactcgggcccgagtccacg

SEQ ID NO: 7826 - DNA, 22 bp, Artificial Sequence
  Description of Artificial Sequence: Synthetic oligonucleotide
ccgactcgggcccgagtcggtg

SEQ ID NO: 7827 - DNA, 22 bp, Artificial Sequence
  Description of Artificial Sequence: Synthetic oligonucleotide
ccgactcgggcccgagtcggag

SEQ ID NO: 7828 - DNA, 22 bp, Artificial Sequence
  Description of Artificial Sequence: Synthetic oligonucleotide
gggactcgggcccgagtcccgc

SEQ ID NO: 7829 - DNA, 22 bp, Artificial Sequence
  Description of Artificial Sequence: Synthetic oligonucleotide
gggactcgggcccgagtccctc

SEQ ID NO: 7830 - DNA, 22 bp, Artificial Sequence
  Description of Artificial Sequence: Synthetic oligonucleotide
gggactcgggcccgagtcccac

SEQ ID NO: 7831 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcggcgccgagtcnnnn

SEQ ID NO: 7832 - DNA, 22 bp, Artificial Sequence
  Description of Artificial Sequence: Synthetic oligonucleotide
cggactcggcgccgagtccgcc

SEQ ID NO: 7833 - DNA, 22 bp, Artificial Sequence
  Description of Artificial Sequence: Synthetic oligonucleotide
cggactcggcgccgagtccgct

SEQ ID NO: 7834 - DNA, 22 bp, Artificial Sequence
  Description of Artificial Sequence: Synthetic oligonucleotide
cggactcggcgccgagtccgtc

SEQ ID NO: 7835 - DNA, 22 bp, Artificial Sequence
  Description of Artificial Sequence: Synthetic oligonucleotide
aggactcggcgccgagtcctcc

SEQ ID NO: 7836 - DNA, 22 bp, Artificial Sequence
  Description of Artificial Sequence: Synthetic oligonucleotide
cagactcggcgccgagtctgcc

SEQ ID NO: 7837 - DNA, 22 bp, Artificial Sequence
  Description of Artificial Sequence: Synthetic oligonucleotide
cggactcggcgccgagtccgca

SEQ ID NO: 7838 - DNA, 22 bp, Artificial Sequence
  Description of Artificial Sequence: Synthetic oligonucleotide
cggactcggcgccgagtccgac

SEQ ID NO: 7839 - DNA, 22 bp, Artificial Sequence
  Description of Artificial Sequence: Synthetic oligonucleotide
tggactcggcgccgagtccacc

SEQ ID NO: 7840 - DNA, 22 bp, Artificial Sequence
  Description of Artificial Sequence: Synthetic oligonucleotide
ctgactcggcgccgagtcagcc

SEQ ID NO: 7841 - DNA, 22 bp, Artificial Sequence
  Description of Artificial Sequence: Synthetic oligonucleotide
ccgactcggcgccgagtcgggc

SEQ ID NO: 7842 - DNA, 22 bp, Artificial Sequence
  Description of Artificial Sequence: Synthetic oligonucleotide
ccgactcggcgccgagtcgggt

SEQ ID NO: 7843 - DNA, 22 bp, Artificial Sequence
  Description of Artificial Sequence: Synthetic oligonucleotide
ccgactcggcgccgagtcggtc

SEQ ID NO: 7844 - DNA, 22 bp, Artificial Sequence
  Description of Artificial Sequence: Synthetic oligonucleotide
acgactcggcgccgagtcgtgc

SEQ ID NO: 7845 - DNA, 22 bp, Artificial Sequence
  Description of Artificial Sequence: Synthetic oligonucleotide
cagactcggcgccgagtctggc

SEQ ID NO: 7846 - DNA, 22 bp, Artificial Sequence
  Description of Artificial Sequence: Synthetic oligonucleotide
ccgactcggcgccgagtcggga

SEQ ID NO: 7847 - DNA, 22 bp, Artificial Sequence
  Description of Artificial Sequence: Synthetic oligonucleotide
ccgactcggcgccgagtcggac

SEQ ID NO: 7848 - DNA, 22 bp, Artificial Sequence
  Description of Artificial Sequence: Synthetic oligonucleotide
ctgactcggcgccgagtcaggc

SEQ ID NO: 7849 - DNA, 22 bp, Artificial Sequence
  Description of Artificial Sequence: Synthetic oligonucleotide
gcgactcggcgccgagtcgccc

SEQ ID NO: 7850 - DNA, 22 bp, Artificial Sequence
  Description of Artificial Sequence: Synthetic oligonucleotide
gcgactcggcgccgagtcgcct

SEQ ID NO: 7851 - DNA, 22 bp, Artificial Sequence
  Description of Artificial Sequence: Synthetic oligonucleotide
gcgactcggcgccgagtcgctc

SEQ ID NO: 7852 - DNA, 22 bp, Artificial Sequence
  Description of Artificial Sequence: Synthetic oligonucleotide
acgactcggcgccgagtcgtcc

SEQ ID NO: 7853 - DNA, 22 bp, Artificial Sequence
  Description of Artificial Sequence: Synthetic oligonucleotide
gagactcggcgccgagtctccc

SEQ ID NO: 7854 - DNA, 22 bp, Artificial Sequence
  Description of Artificial Sequence: Synthetic oligonucleotide
gcgactcggcgccgagtcgcca

SEQ ID NO: 7855 - DNA, 22 bp, Artificial Sequence
  Description of Artificial Sequence: Synthetic oligonucleotide
gcgactcggcgccgagtcgcac

SEQ ID NO: 7856 - DNA, 22 bp, Artificial Sequence
  Description of Artificial Sequence: Synthetic oligonucleotide
gtgactcggcgccgagtcaccc

SEQ ID NO: 7857 - DNA, 22 bp, Artificial Sequence
  Description of Artificial Sequence: Synthetic oligonucleotide
gggactcggcgccgagtcccgt

SEQ ID NO: 7858 - DNA, 22 bp, Artificial Sequence
  Description of Artificial Sequence: Synthetic oligonucleotide
gggactcggcgccgagtccctg

SEQ ID NO: 7859 - DNA, 22 bp, Artificial Sequence
  Description of Artificial Sequence: Synthetic oligonucleotide
aggactcggcgccgagtcctgg

SEQ ID NO: 7860 - DNA, 22 bp, Artificial Sequence
  Description of Artificial Sequence: Synthetic oligonucleotide
gagactcggcgccgagtctcgg

SEQ ID NO: 7861 - DNA, 22 bp, Artificial Sequence
  Description of Artificial Sequence: Synthetic oligonucleotide
gggactcggcgccgagtcccga

SEQ ID NO: 7862 - DNA, 22 bp, Artificial Sequence
  Description of Artificial Sequence: Synthetic oligonucleotide
gggactcggcgccgagtcccag

SEQ ID NO: 7863 - DNA, 22 bp, Artificial Sequence
  Description of Artificial Sequence: Synthetic oligonucleotide
tggactcggcgccgagtccagg

SEQ ID NO: 7864 - DNA, 22 bp, Artificial Sequence
  Description of Artificial Sequence: Synthetic oligonucleotide
gtgactcggcgccgagtcacgg

SEQ ID NO: 7865 - DNA, 22 bp, Artificial Sequence
  Description of Artificial Sequence: Synthetic oligonucleotide
gcgactcggcgccgagtcgccg

SEQ ID NO: 7866 - DNA, 22 bp, Artificial Sequence
  Description of Artificial Sequence: Synthetic oligonucleotide
gcgactcggcgccgagtcgctg

SEQ ID NO: 7867 - DNA, 22 bp, Artificial Sequence
  Description of Artificial Sequence: Synthetic oligonucleotide
acgactcggcgccgagtcgtcg

SEQ ID NO: 7868 - DNA, 22 bp, Artificial Sequence
  Description of Artificial Sequence: Synthetic oligonucleotide
gagactcggcgccgagtctccg

SEQ ID NO: 7869 - DNA, 22 bp, Artificial Sequence
  Description of Artificial Sequence: Synthetic oligonucleotide
gcgactcggcgccgagtcgcag

SEQ ID NO: 7870 - DNA, 22 bp, Artificial Sequence
  Description of Artificial Sequence: Synthetic oligonucleotide
gtgactcggcgccgagtcaccg

SEQ ID NO: 7871 - DNA, 22 bp, Artificial Sequence
  Description of Artificial Sequence: Synthetic oligonucleotide
cggactcggcgccgagtccgtg

SEQ ID NO: 7872 - DNA, 22 bp, Artificial Sequence
  Description of Artificial Sequence: Synthetic oligonucleotide
cagactcggcgccgagtctggg

SEQ ID NO: 7873 - DNA, 22 bp, Artificial Sequence
  Description of Artificial Sequence: Synthetic oligonucleotide
cggactcggcgccgagtccgag

SEQ ID NO: 7874 - DNA, 22 bp, Artificial Sequence
  Description of Artificial Sequence: Synthetic oligonucleotide
ctgactcggcgccgagtcaggg

SEQ ID NO: 7875 - DNA, 22 bp, Artificial Sequence
  Description of Artificial Sequence: Synthetic oligonucleotide
acgactcggcgccgagtcgtgg

SEQ ID NO: 7876 - DNA, 22 bp, Artificial Sequence
  Description of Artificial Sequence: Synthetic oligonucleotide
ccgactcggcgccgagtcggct

SEQ ID NO: 7877 - DNA, 22 bp, Artificial Sequence
  Description of Artificial Sequence: Synthetic oligonucleotide
ccgactcggcgccgagtcggca

SEQ ID NO: 7878 - DNA, 22 bp, Artificial Sequence
  Description of Artificial Sequence: Synthetic oligonucleotide
gagactcggcgccgagtctcgc

SEQ ID NO: 7879 - DNA, 22 bp, Artificial Sequence
  Description of Artificial Sequence: Synthetic oligonucleotide
gtgactcggcgccgagtcacgc

SEQ ID NO: 7880 - DNA, 22 bp, Artificial Sequence
  Description of Artificial Sequence: Synthetic oligonucleotide
aggactcggcgccgagtcctgc

SEQ ID NO: 7881 - DNA, 22 bp, Artificial Sequence
  Description of Artificial Sequence: Synthetic oligonucleotide
tggactcggcgccgagtccagc

SEQ ID NO: 7882 - DNA, 22 bp, Artificial Sequence
  Description of Artificial Sequence: Synthetic oligonucleotide
aggactcggcgccgagtcctcg

SEQ ID NO: 7883 - DNA, 22 bp, Artificial Sequence
  Description of Artificial Sequence: Synthetic oligonucleotide
tggactcggcgccgagtccacg

SEQ ID NO: 7884 - DNA, 22 bp, Artificial Sequence
  Description of Artificial Sequence: Synthetic oligonucleotide
ccgactcggcgccgagtcggtg

SEQ ID NO: 7885 - DNA, 22 bp, Artificial Sequence
  Description of Artificial Sequence: Synthetic oligonucleotide
ccgactcggcgccgagtcggag

SEQ ID NO: 7886 - DNA, 22 bp, Artificial Sequence
  Description of Artificial Sequence: Synthetic oligonucleotide
gggactcggcgccgagtcccgc

SEQ ID NO: 7887 - DNA, 22 bp, Artificial Sequence
  Description of Artificial Sequence: Synthetic oligonucleotide
gggactcggcgccgagtccctc

SEQ ID NO: 7888 - DNA, 22 bp, Artificial Sequence
  Description of Artificial Sequence: Synthetic oligonucleotide
gggactcggcgccgagtcccac

SEQ ID NO: 7889 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcccatgggagtcnnnn

SEQ ID NO: 7890 - DNA, 22 bp, Artificial Sequence
  Description of Artificial Sequence: Synthetic oligonucleotide
cggactcccatgggagtccgcc

SEQ ID NO: 7891 - DNA, 22 bp, Artificial Sequence
  Description of Artificial Sequence: Synthetic oligonucleotide
cggactcccatgggagtccgct

SEQ ID NO: 7892 - DNA, 22 bp, Artificial Sequence
  Description of Artificial Sequence: Synthetic oligonucleotide
cggactcccatgggagtccgtc

SEQ ID NO: 7893 - DNA, 22 bp, Artificial Sequence
  Description of Artificial Sequence: Synthetic oligonucleotide
aggactcccatgggagtcctcc

SEQ ID NO: 7894 - DNA, 22 bp, Artificial Sequence
  Description of Artificial Sequence: Synthetic oligonucleotide
cagactcccatgggagtctgcc

SEQ ID NO: 7895 - DNA, 22 bp, Artificial Sequence
  Description of Artificial Sequence: Synthetic oligonucleotide
cggactcccatgggagtccgca

SEQ ID NO: 7896 - DNA, 22 bp, Artificial Sequence
  Description of Artificial Sequence: Synthetic oligonucleotide
cggactcccatgggagtccgac

SEQ ID NO: 7897 - DNA, 22 bp, Artificial Sequence
  Description of Artificial Sequence: Synthetic oligonucleotide
tggactcccatgggagtccacc

SEQ ID NO: 7898 - DNA, 22 bp, Artificial Sequence
  Description of Artificial Sequence: Synthetic oligonucleotide
ctgactcccatgggagtcagcc

SEQ ID NO: 7899 - DNA, 22 bp, Artificial Sequence
  Description of Artificial Sequence: Synthetic oligonucleotide
ccgactcccatgggagtcgggc

SEQ ID NO: 7900 - DNA, 22 bp, Artificial Sequence
  Description of Artificial Sequence: Synthetic oligonucleotide
ccgactcccatgggagtcgggt

SEQ ID NO: 7901 - DNA, 22 bp, Artificial Sequence
  Description of Artificial Sequence: Synthetic oligonucleotide
ccgactcccatgggagtcggtc

SEQ ID NO: 7902 - DNA, 22 bp, Artificial Sequence
  Description of Artificial Sequence: Synthetic oligonucleotide
acgactcccatgggagtcgtgc

SEQ ID NO: 7903 - DNA, 22 bp, Artificial Sequence
  Description of Artificial Sequence: Synthetic oligonucleotide
cagactcccatgggagtctggc

SEQ ID NO: 7904 - DNA, 22 bp, Artificial Sequence
  Description of Artificial Sequence: Synthetic oligonucleotide
ccgactcccatgggagtcggga

SEQ ID NO: 7905 - DNA, 22 bp, Artificial Sequence
  Description of Artificial Sequence: Synthetic oligonucleotide
ccgactcccatgggagtcggac

SEQ ID NO: 7906 - DNA, 22 bp, Artificial Sequence
  Description of Artificial Sequence: Synthetic oligonucleotide
ctgactcccatgggagtcaggc

SEQ ID NO: 7907 - DNA, 22 bp, Artificial Sequence
  Description of Artificial Sequence: Synthetic oligonucleotide
gcgactcccatgggagtcgccc

SEQ ID NO: 7908 - DNA, 22 bp, Artificial Sequence
  Description of Artificial Sequence: Synthetic oligonucleotide
gcgactcccatgggagtcgcct

SEQ ID NO: 7909 - DNA, 22 bp, Artificial Sequence
  Description of Artificial Sequence: Synthetic oligonucleotide
gcgactcccatgggagtcgctc

SEQ ID NO: 7910 - DNA, 22 bp, Artificial Sequence
  Description of Artificial Sequence: Synthetic oligonucleotide
acgactcccatgggagtcgtcc

SEQ ID NO: 7911 - DNA, 22 bp, Artificial Sequence
  Description of Artificial Sequence: Synthetic oligonucleotide
gagactcccatgggagtctccc

SEQ ID NO: 7912 - DNA, 22 bp, Artificial Sequence
  Description of Artificial Sequence: Synthetic oligonucleotide
gcgactcccatgggagtcgcca

SEQ ID NO: 7913 - DNA, 22 bp, Artificial Sequence
  Description of Artificial Sequence: Synthetic oligonucleotide
gcgactcccatgggagtcgcac

SEQ ID NO: 7914 - DNA, 22 bp, Artificial Sequence
  Description of Artificial Sequence: Synthetic oligonucleotide
gtgactcccatgggagtcaccc

SEQ ID NO: 7915 - DNA, 22 bp, Artificial Sequence
  Description of Artificial Sequence: Synthetic oligonucleotide
gggactcccatgggagtcccgt

SEQ ID NO: 7916 - DNA, 22 bp, Artificial Sequence
  Description of Artificial Sequence: Synthetic oligonucleotide
gggactcccatgggagtccctg

SEQ ID NO: 7917 - DNA, 22 bp, Artificial Sequence
  Description of Artificial Sequence: Synthetic oligonucleotide
aggactcccatgggagtcctgg

SEQ ID NO: 7918 - DNA, 22 bp, Artificial Sequence
  Description of Artificial Sequence: Synthetic oligonucleotide
gagactcccatgggagtctcgg

SEQ ID NO: 7919 - DNA, 22 bp, Artificial Sequence
  Description of Artificial Sequence: Synthetic oligonucleotide
gggactcccatgggagtcccga

SEQ ID NO: 7920 - DNA, 22 bp, Artificial Sequence
  Description of Artificial Sequence: Synthetic oligonucleotide
gggactcccatgggagtcccag

SEQ ID NO: 7921 - DNA, 22 bp, Artificial Sequence
  Description of Artificial Sequence: Synthetic oligonucleotide
tggactcccatgggagtccagg

SEQ ID NO: 7922 - DNA, 22 bp, Artificial Sequence
  Description of Artificial Sequence: Synthetic oligonucleotide
gtgactcccatgggagtcacgg

SEQ ID NO: 7923 - DNA, 22 bp, Artificial Sequence
  Description of Artificial Sequence: Synthetic oligonucleotide
gcgactcccatgggagtcgccg

SEQ ID NO: 7924 - DNA, 22 bp, Artificial Sequence
  Description of Artificial Sequence: Synthetic oligonucleotide
gcgactcccatgggagtcgctg

SEQ ID NO: 7925 - DNA, 22 bp, Artificial Sequence
  Description of Artificial Sequence: Synthetic oligonucleotide
acgactcccatgggagtcgtcg

SEQ ID NO: 7926 - DNA, 22 bp, Artificial Sequence
  Description of Artificial Sequence: Synthetic oligonucleotide
gagactcccatgggagtctccg

SEQ ID NO: 7927 - DNA, 22 bp, Artificial Sequence
  Description of Artificial Sequence: Synthetic oligonucleotide
gcgactcccatgggagtcgcag

SEQ ID NO: 7928 - DNA, 22 bp, Artificial Sequence
  Description of Artificial Sequence: Synthetic oligonucleotide
gtgactcccatgggagtcaccg

SEQ ID NO: 7929 - DNA, 22 bp, Artificial Sequence
  Description of Artificial Sequence: Synthetic oligonucleotide
cggactcccatgggagtccgtg

SEQ ID NO: 7930 - DNA, 22 bp, Artificial Sequence
  Description of Artificial Sequence: Synthetic oligonucleotide
cagactcccatgggagtctggg

SEQ ID NO: 7931 - DNA, 22 bp, Artificial Sequence
  Description of Artificial Sequence: Synthetic oligonucleotide
cggactcccatgggagtccgag

SEQ ID NO: 7932 - DNA, 22 bp, Artificial Sequence
  Description of Artificial Sequence: Synthetic oligonucleotide
ctgactcccatgggagtcaggg

SEQ ID NO: 7933 - DNA, 22 bp, Artificial Sequence
  Description of Artificial Sequence: Synthetic oligonucleotide
acgactcccatgggagtcgtgg

SEQ ID NO: 7934 - DNA, 22 bp, Artificial Sequence
  Description of Artificial Sequence: Synthetic oligonucleotide
ccgactcccatgggagtcggct

SEQ ID NO: 7935 - DNA, 22 bp, Artificial Sequence
  Description of Artificial Sequence: Synthetic oligonucleotide
ccgactcccatgggagtcggca

SEQ ID NO: 7936 - DNA, 22 bp, Artificial Sequence
  Description of Artificial Sequence: Synthetic oligonucleotide
gagactcccatgggagtctcgc

SEQ ID NO: 7937 - DNA, 22 bp, Artificial Sequence
  Description of Artificial Sequence: Synthetic oligonucleotide
gtgactcccatgggagtcacgc

SEQ ID NO: 7938 - DNA, 22 bp, Artificial Sequence
  Description of Artificial Sequence: Synthetic oligonucleotide
aggactcccatgggagtcctgc

SEQ ID NO: 7939 - DNA, 22 bp, Artificial Sequence
  Description of Artificial Sequence: Synthetic oligonucleotide
tggactcccatgggagtccagc

SEQ ID NO: 7940 - DNA, 22 bp, Artificial Sequence
  Description of Artificial Sequence: Synthetic oligonucleotide
aggactcccatgggagtcctcg

SEQ ID NO: 7941 - DNA, 22 bp, Artificial Sequence
  Description of Artificial Sequence: Synthetic oligonucleotide
tggactcccatgggagtccacg

SEQ ID NO: 7942 - DNA, 22 bp, Artificial Sequence
  Description of Artificial Sequence: Synthetic oligonucleotide
ccgactcccatgggagtcggtg

SEQ ID NO: 7943 - DNA, 22 bp, Artificial Sequence
  Description of Artificial Sequence: Synthetic oligonucleotide
ccgactcccatgggagtcggag

SEQ ID NO: 7944 - DNA, 22 bp, Artificial Sequence
  Description of Artificial Sequence: Synthetic oligonucleotide
gggactcccatgggagtcccgc

SEQ ID NO: 7945 - DNA, 22 bp, Artificial Sequence
  Description of Artificial Sequence: Synthetic oligonucleotide
gggactcccatgggagtccctc

SEQ ID NO: 7946 - DNA, 22 bp, Artificial Sequence
  Description of Artificial Sequence: Synthetic oligonucleotide
gggactcccatgggagtcccac

SEQ ID NO: 7947 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccctagggagtcnnnn

SEQ ID NO: 7948 - DNA, 22 bp, Artificial Sequence
  Description of Artificial Sequence: Synthetic oligonucleotide
cggactccctagggagtccgcc

SEQ ID NO: 7949 - DNA, 22 bp, Artificial Sequence
  Description of Artificial Sequence: Synthetic oligonucleotide
cggactccctagggagtccgct

SEQ ID NO: 7950 - DNA, 22 bp, Artificial Sequence
  Description of Artificial Sequence: Synthetic oligonucleotide
cggactccctagggagtccgtc

SEQ ID NO: 7951 - DNA, 22 bp, Artificial Sequence
  Description of Artificial Sequence: Synthetic oligonucleotide
aggactccctagggagtcctcc

SEQ ID NO: 7952 - DNA, 22 bp, Artificial Sequence
  Description of Artificial Sequence: Synthetic oligonucleotide
cagactccctagggagtctgcc

SEQ ID NO: 7953 - DNA, 22 bp, Artificial Sequence
  Description of Artificial Sequence: Synthetic oligonucleotide
cggactccctagggagtccgca

SEQ ID NO: 7954 - DNA, 22 bp, Artificial Sequence
  Description of Artificial Sequence: Synthetic oligonucleotide
cggactccctagggagtccgac

SEQ ID NO: 7955 - DNA, 22 bp, Artificial Sequence
  Description of Artificial Sequence: Synthetic oligonucleotide
tggactccctagggagtccacc

SEQ ID NO: 7956 - DNA, 22 bp, Artificial Sequence
  Description of Artificial Sequence: Synthetic oligonucleotide
ctgactccctagggagtcagcc

SEQ ID NO: 7957 - DNA, 22 bp, Artificial Sequence
  Description of Artificial Sequence: Synthetic oligonucleotide
ccgactccctagggagtcgggc

SEQ ID NO: 7958 - DNA, 22 bp, Artificial Sequence
  Description of Artificial Sequence: Synthetic oligonucleotide
ccgactccctagggagtcgggt

SEQ ID NO: 7959 - DNA, 22 bp, Artificial Sequence
  Description of Artificial Sequence: Synthetic oligonucleotide
ccgactccctagggagtcggtc

SEQ ID NO: 7960 - DNA, 22 bp, Artificial Sequence
  Description of Artificial Sequence: Synthetic oligonucleotide
acgactccctagggagtcgtgc

SEQ ID NO: 7961 - DNA, 22 bp, Artificial Sequence
  Description of Artificial Sequence: Synthetic oligonucleotide
cagactccctagggagtctggc

SEQ ID NO: 7962 - DNA, 22 bp, Artificial Sequence
  Description of Artificial Sequence: Synthetic oligonucleotide
ccgactccctagggagtcggga

SEQ ID NO: 7963 - DNA, 22 bp, Artificial Sequence
  Description of Artificial Sequence: Synthetic oligonucleotide
ccgactccctagggagtcggac

SEQ ID NO: 7964 - DNA, 22 bp, Artificial Sequence
  Description of Artificial Sequence: Synthetic oligonucleotide
ctgactccctagggagtcaggc

SEQ ID NO: 7965 - DNA, 22 bp, Artificial Sequence
  Description of Artificial Sequence: Synthetic oligonucleotide
gcgactccctagggagtcgccc

SEQ ID NO: 7966 - DNA, 22 bp, Artificial Sequence
  Description of Artificial Sequence: Synthetic oligonucleotide
gcgactccctagggagtcgcct

SEQ ID NO: 7967 - DNA, 22 bp, Artificial Sequence
  Description of Artificial Sequence: Synthetic oligonucleotide
gcgactccctagggagtcgctc

SEQ ID NO: 7968 - DNA, 22 bp, Artificial Sequence
  Description of Artificial Sequence: Synthetic oligonucleotide
acgactccctagggagtcgtcc

SEQ ID NO: 7969 - DNA, 22 bp, Artificial Sequence
  Description of Artificial Sequence: Synthetic oligonucleotide
gagactccctagggagtctccc

SEQ ID NO: 7970 - DNA, 22 bp, Artificial Sequence
  Description of Artificial Sequence: Synthetic oligonucleotide
gcgactccctagggagtcgcca

SEQ ID NO: 7971 - DNA, 22 bp, Artificial Sequence
  Description of Artificial Sequence: Synthetic oligonucleotide
gcgactccctagggagtcgcac

SEQ ID NO: 7972 - DNA, 22 bp, Artificial Sequence
  Description of Artificial Sequence: Synthetic oligonucleotide
gtgactccctagggagtcaccc

SEQ ID NO: 7973 - DNA, 22 bp, Artificial Sequence
  Description of Artificial Sequence: Synthetic oligonucleotide
gggactccctagggagtcccgt

SEQ ID NO: 7974 - DNA, 22 bp, Artificial Sequence
  Description of Artificial Sequence: Synthetic oligonucleotide
gggactccctagggagtccctg

SEQ ID NO: 7975 - DNA, 22 bp, Artificial Sequence
  Description of Artificial Sequence: Synthetic oligonucleotide
aggactccctagggagtcctgg

SEQ ID NO: 7976 - DNA, 22 bp, Artificial Sequence
  Description of Artificial Sequence: Synthetic oligonucleotide
gagactccctagggagtctcgg

SEQ ID NO: 7977 - DNA, 22 bp, Artificial Sequence
  Description of Artificial Sequence: Synthetic oligonucleotide
gggactccctagggagtcccga

SEQ ID NO: 7978 - DNA, 22 bp, Artificial Sequence
  Description of Artificial Sequence: Synthetic oligonucleotide
gggactccctagggagtcccag

SEQ ID NO: 7979 - DNA, 22 bp, Artificial Sequence
  Description of Artificial Sequence: Synthetic oligonucleotide
tggactccctagggagtccagg

SEQ ID NO: 7980 - DNA, 22 bp, Artificial Sequence
  Description of Artificial Sequence: Synthetic oligonucleotide
gtgactccctagggagtcacgg

SEQ ID NO: 7981 - DNA, 22 bp, Artificial Sequence
  Description of Artificial Sequence: Synthetic oligonucleotide
gcgactccctagggagtcgccg

SEQ ID NO: 7982 - DNA, 22 bp, Artificial Sequence
  Description of Artificial Sequence: Synthetic oligonucleotide
gcgactccctagggagtcgctg

SEQ ID NO: 7983 - DNA, 22 bp, Artificial Sequence
  Description of Artificial Sequence: Synthetic oligonucleotide
acgactccctagggagtcgtcg

SEQ ID NO: 7984 - DNA, 22 bp, Artificial Sequence
  Description of Artificial Sequence: Synthetic oligonucleotide
gagactccctagggagtctccg

SEQ ID NO: 7985 - DNA, 22 bp, Artificial Sequence
  Description of Artificial Sequence: Synthetic oligonucleotide
gcgactccctagggagtcgcag

SEQ ID NO: 7986 - DNA, 22 bp, Artificial Sequence
  Description of Artificial Sequence: Synthetic oligonucleotide
gtgactccctagggagtcaccg

SEQ ID NO: 7987 - DNA, 22 bp, Artificial Sequence
  Description of Artificial Sequence: Synthetic oligonucleotide
cggactccctagggagtccgtg

SEQ ID NO: 7988 - DNA, 22 bp, Artificial Sequence
  Description of Artificial Sequence: Synthetic oligonucleotide
cagactccctagggagtctggg

SEQ ID NO: 7989 - DNA, 22 bp, Artificial Sequence
  Description of Artificial Sequence: Synthetic oligonucleotide
cggactccctagggagtccgag

SEQ ID NO: 7990 - DNA, 22 bp, Artificial Sequence
  Description of Artificial Sequence: Synthetic oligonucleotide
ctgactccctagggagtcaggg

SEQ ID NO: 7991 - DNA, 22 bp, Artificial Sequence
  Description of Artificial Sequence: Synthetic oligonucleotide
acgactccctagggagtcgtgg

SEQ ID NO: 7992 - DNA, 22 bp, Artificial Sequence
  Description of Artificial Sequence: Synthetic oligonucleotide
ccgactccctagggagtcggct

SEQ ID NO: 7993 - DNA, 22 bp, Artificial Sequence
  Description of Artificial Sequence: Synthetic oligonucleotide
ccgactccctagggagtcggca

SEQ ID NO: 7994 - DNA, 22 bp, Artificial Sequence
  Description of Artificial Sequence: Synthetic oligonucleotide
gagactccctagggagtctcgc

SEQ ID NO: 7995 - DNA, 22 bp, Artificial Sequence
  Description of Artificial Sequence: Synthetic oligonucleotide
gtgactccctagggagtcacgc

SEQ ID NO: 7996 - DNA, 22 bp, Artificial Sequence
  Description of Artificial Sequence: Synthetic oligonucleotide
aggactccctagggagtcctgc

SEQ ID NO: 7997 - DNA, 22 bp, Artificial Sequence
  Description of Artificial Sequence: Synthetic oligonucleotide
tggactccctagggagtccagc

SEQ ID NO: 7998 - DNA, 22 bp, Artificial Sequence
  Description of Artificial Sequence: Synthetic oligonucleotide
aggactccctagggagtcctcg

SEQ ID NO: 7999 - DNA, 22 bp, Artificial Sequence
  Description of Artificial Sequence: Synthetic oligonucleotide
tggactccctagggagtccacg

SEQ ID NO: 8000 - DNA, 22 bp, Artificial Sequence
  Description of Artificial Sequence: Synthetic oligonucleotide
ccgactccctagggagtcggtg

SEQ ID NO: 8001 - DNA, 22 bp, Artificial Sequence
  Description of Artificial Sequence: Synthetic oligonucleotide
ccgactccctagggagtcggag

SEQ ID NO: 8002 - DNA, 22 bp, Artificial Sequence
  Description of Artificial Sequence: Synthetic oligonucleotide
gggactccctagggagtcccgc

SEQ ID NO: 8003 - DNA, 22 bp, Artificial Sequence
  Description of Artificial Sequence: Synthetic oligonucleotide
gggactccctagggagtccctc

SEQ ID NO: 8004 - DNA, 22 bp, Artificial Sequence
  Description of Artificial Sequence: Synthetic oligonucleotide
gggactccctagggagtcccac

SEQ ID NO: 8005 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcccgcgggagtcnnnn

SEQ ID NO: 8006 - DNA, 22 bp, Artificial Sequence
  Description of Artificial Sequence: Synthetic oligonucleotide
cggactcccgcgggagtccgcc

SEQ ID NO: 8007 - DNA, 22 bp, Artificial Sequence
  Description of Artificial Sequence: Synthetic oligonucleotide
cggactcccgcgggagtccgct

SEQ ID NO: 8008 - DNA, 22 bp, Artificial Sequence
  Description of Artificial Sequence: Synthetic oligonucleotide
cggactcccgcgggagtccgtc

SEQ ID NO: 8009 - DNA, 22 bp, Artificial Sequence
  Description of Artificial Sequence: Synthetic oligonucleotide
aggactcccgcgggagtcctcc

SEQ ID NO: 8010 - DNA, 22 bp, Artificial Sequence
  Description of Artificial Sequence: Synthetic oligonucleotide
cagactcccgcgggagtctgcc

SEQ ID NO: 8011 - DNA, 22 bp, Artificial Sequence
  Description of Artificial Sequence: Synthetic oligonucleotide
cggactcccgcgggagtccgca

SEQ ID NO: 8012 - DNA, 22 bp, Artificial Sequence
  Description of Artificial Sequence: Synthetic oligonucleotide
cggactcccgcgggagtccgac

SEQ ID NO: 8013 - DNA, 22 bp, Artificial Sequence
  Description of Artificial Sequence: Synthetic oligonucleotide
tggactcccgcgggagtccacc

SEQ ID NO: 8014 - DNA, 22 bp, Artificial Sequence
  Description of Artificial Sequence: Synthetic oligonucleotide
ctgactcccgcgggagtcagcc

SEQ ID NO: 8015 - DNA, 22 bp, Artificial Sequence
  Description of Artificial Sequence: Synthetic oligonucleotide
ccgactcccgcgggagtcgggc

SEQ ID NO: 8016 - DNA, 22 bp, Artificial Sequence
  Description of Artificial Sequence: Synthetic oligonucleotide
ccgactcccgcgggagtcgggt

SEQ ID NO: 8017 - DNA, 22 bp, Artificial Sequence
  Description of Artificial Sequence: Synthetic oligonucleotide
ccgactcccgcgggagtcggtc

SEQ ID NO: 8018 - DNA, 22 bp, Artificial Sequence
  Description of Artificial Sequence: Synthetic oligonucleotide
acgactcccgcgggagtcgtgc

SEQ ID NO: 8019 - DNA, 22 bp, Artificial Sequence
  Description of Artificial Sequence: Synthetic oligonucleotide
cagactcccgcgggagtctggc

SEQ ID NO: 8020 - DNA, 22 bp, Artificial Sequence
  Description of Artificial Sequence: Synthetic oligonucleotide
ccgactcccgcgggagtcggga

SEQ ID NO: 8021 - DNA, 22 bp, Artificial Sequence
  Description of Artificial Sequence: Synthetic oligonucleotide
ccgactcccgcgggagtcggac

SEQ ID NO: 8022 - DNA, 22 bp, Artificial Sequence
  Description of Artificial Sequence: Synthetic oligonucleotide
ctgactcccgcgggagtcaggc

SEQ ID NO: 8023 - DNA, 22 bp, Artificial Sequence
  Description of Artificial Sequence: Synthetic oligonucleotide
gcgactcccgcgggagtcgccc

SEQ ID NO: 8024 - DNA, 22 bp, Artificial Sequence
  Description of Artificial Sequence: Synthetic oligonucleotide
gcgactcccgcgggagtcgcct

SEQ ID NO: 8025 - DNA, 22 bp, Artificial Sequence
  Description of Artificial Sequence: Synthetic oligonucleotide
gcgactcccgcgggagtcgctc

SEQ ID NO: 8026 - DNA, 22 bp, Artificial Sequence
  Description of Artificial Sequence: Synthetic oligonucleotide
acgactcccgcgggagtcgtcc

SEQ ID NO: 8027 - DNA, 22 bp, Artificial Sequence
  Description of Artificial Sequence: Synthetic oligonucleotide
gagactcccgcgggagtctccc

SEQ ID NO: 8028 - DNA, 22 bp, Artificial Sequence
  Description of Artificial Sequence: Synthetic oligonucleotide
gcgactcccgcgggagtcgcca

SEQ ID NO: 8029 - DNA, 22 bp, Artificial Sequence
  Description of Artificial Sequence: Synthetic oligonucleotide
gcgactcccgcgggagtcgcac

SEQ ID NO: 8030 - DNA, 22 bp, Artificial Sequence
  Description of Artificial Sequence: Synthetic oligonucleotide
gtgactcccgcgggagtcaccc

SEQ ID NO: 8031 - DNA, 22 bp, Artificial Sequence
  Description of Artificial Sequence: Synthetic oligonucleotide
gggactcccgcgggagtcccgt

SEQ ID NO: 8032 - DNA, 22 bp, Artificial Sequence
  Description of Artificial Sequence: Synthetic oligonucleotide
gggactcccgcgggagtccctg

SEQ ID NO: 8033 - DNA, 22 bp, Artificial Sequence
  Description of Artificial Sequence: Synthetic oligonucleotide
aggactcccgcgggagtcctgg

SEQ ID NO: 8034 - DNA, 22 bp, Artificial Sequence
  Description of Artificial Sequence: Synthetic oligonucleotide
gagactcccgcgggagtctcgg

SEQ ID NO: 8035 - DNA, 22 bp, Artificial Sequence
  Description of Artificial Sequence: Synthetic oligonucleotide
gggactcccgcgggagtcccga

SEQ ID NO: 8036 - DNA, 22 bp, Artificial Sequence
  Description of Artificial Sequence: Synthetic oligonucleotide
gggactcccgcgggagtcccag

SEQ ID NO: 8037 - DNA, 22 bp, Artificial Sequence
  Description of Artificial Sequence: Synthetic oligonucleotide
tggactcccgcgggagtccagg

SEQ ID NO: 8038 - DNA, 22 bp, Artificial Sequence
  Description of Artificial Sequence: Synthetic oligonucleotide
gtgactcccgcgggagtcacgg

SEQ ID NO: 8039 - DNA, 22 bp, Artificial Sequence
  Description of Artificial Sequence: Synthetic oligonucleotide
gcgactcccgcgggagtcgccg

SEQ ID NO: 8040 - DNA, 22 bp, Artificial Sequence
  Description of Artificial Sequence: Synthetic oligonucleotide
gcgactcccgcgggagtcgctg

SEQ ID NO: 8041 - DNA, 22 bp, Artificial Sequence
  Description of Artificial Sequence: Synthetic oligonucleotide
acgactcccgcgggagtcgtcg

SEQ ID NO: 8042 - DNA, 22 bp, Artificial Sequence
  Description of Artificial Sequence: Synthetic oligonucleotide
gagactcccgcgggagtctccg

SEQ ID NO: 8043 - DNA, 22 bp, Artificial Sequence
  Description of Artificial Sequence: Synthetic oligonucleotide
gcgactcccgcgggagtcgcag

SEQ ID NO: 8044 - DNA, 22 bp, Artificial Sequence
  Description of Artificial Sequence: Synthetic oligonucleotide
gtgactcccgcgggagtcaccg

SEQ ID NO: 8045 - DNA, 22 bp, Artificial Sequence
  Description of Artificial Sequence: Synthetic oligonucleotide
cggactcccgcgggagtccgtg

SEQ ID NO: 8046 - DNA, 22 bp, Artificial Sequence
  Description of Artificial Sequence: Synthetic oligonucleotide
cagactcccgcgggagtctggg

SEQ ID NO: 8047 - DNA, 22 bp, Artificial Sequence
  Description of Artificial Sequence: Synthetic oligonucleotide
cggactcccgcgggagtccgag

SEQ ID NO: 8048 - DNA, 22 bp, Artificial Sequence
  Description of Artificial Sequence: Synthetic oligonucleotide
ctgactcccgcgggagtcaggg

SEQ ID NO: 8049 - DNA, 22 bp, Artificial Sequence
  Description of Artificial Sequence: Synthetic oligonucleotide
acgactcccgcgggagtcgtgg

SEQ ID NO: 8050 - DNA, 22 bp, Artificial Sequence
  Description of Artificial Sequence: Synthetic oligonucleotide
ccgactcccgcgggagtcggct

SEQ ID NO: 8051 - DNA, 22 bp, Artificial Sequence
  Description of Artificial Sequence: Synthetic oligonucleotide
ccgactcccgcgggagtcggca

SEQ ID NO: 8052 - DNA, 22 bp, Artificial Sequence
  Description of Artificial Sequence: Synthetic oligonucleotide
gagactcccgcgggagtctcgc

SEQ ID NO: 8053 - DNA, 22 bp, Artificial Sequence
  Description of Artificial Sequence: Synthetic oligonucleotide
gtgactcccgcgggagtcacgc

SEQ ID NO: 8054 - DNA, 22 bp, Artificial Sequence
  Description of Artificial Sequence: Synthetic oligonucleotide
aggactcccgcgggagtcctgc

SEQ ID NO: 8055 - DNA, 22 bp, Artificial Sequence
  Description of Artificial Sequence: Synthetic oligonucleotide
tggactcccgcgggagtccagc

SEQ ID NO: 8056 - DNA, 22 bp, Artificial Sequence
  Description of Artificial Sequence: Synthetic oligonucleotide
aggactcccgcgggagtcctcg

SEQ ID NO: 8057 - DNA, 22 bp, Artificial Sequence
  Description of Artificial Sequence: Synthetic oligonucleotide
tggactcccgcgggagtccacg

SEQ ID NO: 8058 - DNA, 22 bp, Artificial Sequence
  Description of Artificial Sequence: Synthetic oligonucleotide
ccgactcccgcgggagtcggtg

SEQ ID NO: 8059 - DNA, 22 bp, Artificial Sequence
  Description of Artificial Sequence: Synthetic oligonucleotide
ccgactcccgcgggagtcggag

SEQ ID NO: 8060 - DNA, 22 bp, Artificial Sequence
  Description of Artificial Sequence: Synthetic oligonucleotide
gggactcccgcgggagtcccgc

SEQ ID NO: 8061 - DNA, 22 bp, Artificial Sequence
  Description of Artificial Sequence: Synthetic oligonucleotide
gggactcccgcgggagtccctc

SEQ ID NO: 8062 - DNA, 22 bp, Artificial Sequence
  Description of Artificial Sequence: Synthetic oligonucleotide
gggactcccgcgggagtcccac

SEQ ID NO: 8063 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccccggggagtcnnnn

SEQ ID NO: 8064 - DNA, 22 bp, Artificial Sequence
  Description of Artificial Sequence: Synthetic oligonucleotide
cggactccccggggagtccgcc

SEQ ID NO: 8065 - DNA, 22 bp, Artificial Sequence
  Description of Artificial Sequence: Synthetic oligonucleotide
cggactccccggggagtccgct

SEQ ID NO: 8066 - DNA, 22 bp, Artificial Sequence
  Description of Artificial Sequence: Synthetic oligonucleotide
cggactccccggggagtccgtc

SEQ ID NO: 8067 - DNA, 22 bp, Artificial Sequence
  Description of Artificial Sequence: Synthetic oligonucleotide
aggactccccggggagtcctcc

SEQ ID NO: 8068 - DNA, 22 bp, Artificial Sequence
  Description of Artificial Sequence: Synthetic oligonucleotide
cagactccccggggagtctgcc

SEQ ID NO: 8069 - DNA, 22 bp, Artificial Sequence
  Description of Artificial Sequence: Synthetic oligonucleotide
cggactccccggggagtccgca

SEQ ID NO: 8070 - DNA, 22 bp, Artificial Sequence
  Description of Artificial Sequence: Synthetic oligonucleotide
cggactccccggggagtccgac

SEQ ID NO: 8071 - DNA, 22 bp, Artificial Sequence
  Description of Artificial Sequence: Synthetic oligonucleotide
tggactccccggggagtccacc

SEQ ID NO: 8072 - DNA, 22 bp, Artificial Sequence
  Description of Artificial Sequence: Synthetic oligonucleotide
ctgactccccggggagtcagcc

SEQ ID NO: 8073 - DNA, 22 bp, Artificial Sequence
  Description of Artificial Sequence: Synthetic oligonucleotide
ccgactccccggggagtcgggc

SEQ ID NO: 8074 - DNA, 22 bp, Artificial Sequence
  Description of Artificial Sequence: Synthetic oligonucleotide
ccgactccccggggagtcgggt

SEQ ID NO: 8075 - DNA, 22 bp, Artificial Sequence
  Description of Artificial Sequence: Synthetic oligonucleotide
ccgactccccggggagtcggtc

SEQ ID NO: 8076 - DNA, 22 bp, Artificial Sequence
  Description of Artificial Sequence: Synthetic oligonucleotide
acgactccccggggagtcgtgc

SEQ ID NO: 8077 - DNA, 22 bp, Artificial Sequence
  Description of Artificial Sequence: Synthetic oligonucleotide
cagactccccggggagtctggc

SEQ ID NO: 8078 - DNA, 22 bp, Artificial Sequence
  Description of Artificial Sequence: Synthetic oligonucleotide
ccgactccccggggagtcggga

SEQ ID NO: 8079 - DNA, 22 bp, Artificial Sequence
  Description of Artificial Sequence: Synthetic oligonucleotide
ccgactccccggggagtcggac

SEQ ID NO: 8080 - DNA, 22 bp, Artificial Sequence
  Description of Artificial Sequence: Synthetic oligonucleotide
ctgactccccggggagtcaggc

SEQ ID NO: 8081 - DNA, 22 bp, Artificial Sequence
  Description of Artificial Sequence: Synthetic oligonucleotide
gcgactccccggggagtcgccc

SEQ ID NO: 8082 - DNA, 22 bp, Artificial Sequence
  Description of Artificial Sequence: Synthetic oligonucleotide
gcgactccccggggagtcgcct

SEQ ID NO: 8083 - DNA, 22 bp, Artificial Sequence
  Description of Artificial Sequence: Synthetic oligonucleotide
gcgactccccggggagtcgctc

SEQ ID NO: 8084 - DNA, 22 bp, Artificial Sequence
  Description of Artificial Sequence: Synthetic oligonucleotide
acgactccccggggagtcgtcc

SEQ ID NO: 8085 - DNA, 22 bp, Artificial Sequence
  Description of Artificial Sequence: Synthetic oligonucleotide
gagactccccggggagtctccc

SEQ ID NO: 8086 - DNA, 22 bp, Artificial Sequence
  Description of Artificial Sequence: Synthetic oligonucleotide
gcgactccccggggagtcgcca

SEQ ID NO: 8087 - DNA, 22 bp, Artificial Sequence
  Description of Artificial Sequence: Synthetic oligonucleotide
gcgactccccggggagtcgcac

SEQ ID NO: 8088 - DNA, 22 bp, Artificial Sequence
  Description of Artificial Sequence: Synthetic oligonucleotide
gtgactccccggggagtcaccc

SEQ ID NO: 8089 - DNA, 22 bp, Artificial Sequence
  Description of Artificial Sequence: Synthetic oligonucleotide
gggactccccggggagtcccgt

SEQ ID NO: 8090 - DNA, 22 bp, Artificial Sequence
  Description of Artificial Sequence: Synthetic oligonucleotide
gggactccccggggagtccctg

SEQ ID NO: 8091 - DNA, 22 bp, Artificial Sequence
  Description of Artificial Sequence: Synthetic oligonucleotide
aggactccccggggagtcctgg

SEQ ID NO: 8092 - DNA, 22 bp, Artificial Sequence
  Description of Artificial Sequence: Synthetic oligonucleotide
gagactccccggggagtctcgg

SEQ ID NO: 8093 - DNA, 22 bp, Artificial Sequence
  Description of Artificial Sequence: Synthetic oligonucleotide
gggactccccggggagtcccga

SEQ ID NO: 8094 - DNA, 22 bp, Artificial Sequence
  Description of Artificial Sequence: Synthetic oligonucleotide
gggactccccggggagtcccag

SEQ ID NO: 8095 - DNA, 22 bp, Artificial Sequence
  Description of Artificial Sequence: Synthetic oligonucleotide
tggactccccggggagtccagg

SEQ ID NO: 8096 - DNA, 22 bp, Artificial Sequence
  Description of Artificial Sequence: Synthetic oligonucleotide
gtgactccccggggagtcacgg

SEQ ID NO: 8097 - DNA, 22 bp, Artificial Sequence
  Description of Artificial Sequence: Synthetic oligonucleotide
gcgactccccggggagtcgccg

SEQ ID NO: 8098 - DNA, 22 bp, Artificial Sequence
  Description of Artificial Sequence: Synthetic oligonucleotide
gcgactccccggggagtcgctg

SEQ ID NO: 8099 - DNA, 22 bp, Artificial Sequence
  Description of Artificial Sequence: Synthetic oligonucleotide
acgactccccggggagtcgtcg

SEQ ID NO: 8100 - DNA, 22 bp, Artificial Sequence
  Description of Artificial Sequence: Synthetic oligonucleotide
gagactccccggggagtctccg

SEQ ID NO: 8101 - DNA, 22 bp, Artificial Sequence
  Description of Artificial Sequence: Synthetic oligonucleotide
gcgactccccggggagtcgcag

SEQ ID NO: 8102 - DNA, 22 bp, Artificial Sequence
  Description of Artificial Sequence: Synthetic oligonucleotide
gtgactccccggggagtcaccg

SEQ ID NO: 8103 - DNA, 22 bp, Artificial Sequence
  Description of Artificial Sequence: Synthetic oligonucleotide
cggactccccggggagtccgtg

SEQ ID NO: 8104 - DNA, 22 bp, Artificial Sequence
  Description of Artificial Sequence: Synthetic oligonucleotide
cagactccccggggagtctggg

SEQ ID NO: 8105 - DNA, 22 bp, Artificial Sequence
  Description of Artificial Sequence: Synthetic oligonucleotide
cggactccccggggagtccgag

SEQ ID NO: 8106 - DNA, 22 bp, Artificial Sequence
  Description of Artificial Sequence: Synthetic oligonucleotide
ctgactccccggggagtcaggg

SEQ ID NO: 8107 - DNA, 22 bp, Artificial Sequence
  Description of Artificial Sequence: Synthetic oligonucleotide
acgactccccggggagtcgtgg

SEQ ID NO: 8108 - DNA, 22 bp, Artificial Sequence
  Description of Artificial Sequence: Synthetic oligonucleotide
ccgactccccggggagtcggct

SEQ ID NO: 8109 - DNA, 22 bp, Artificial Sequence
  Description of Artificial Sequence: Synthetic oligonucleotide
ccgactccccggggagtcggca

SEQ ID NO: 8110 - DNA, 22 bp, Artificial Sequence
  Description of Artificial Sequence: Synthetic oligonucleotide
gagactccccggggagtctcgc

SEQ ID NO: 8111 - DNA, 22 bp, Artificial Sequence
  Description of Artificial Sequence: Synthetic oligonucleotide
gtgactccccggggagtcacgc

SEQ ID NO: 8112 - DNA, 22 bp, Artificial Sequence
  Description of Artificial Sequence: Synthetic oligonucleotide
aggactccccggggagtcctgc

SEQ ID NO: 8113 - DNA, 22 bp, Artificial Sequence
  Description of Artificial Sequence: Synthetic oligonucleotide
tggactccccggggagtccagc

SEQ ID NO: 8114 - DNA, 22 bp, Artificial Sequence
  Description of Artificial Sequence: Synthetic oligonucleotide
aggactccccggggagtcctcg

SEQ ID NO: 8115 - DNA, 22 bp, Artificial Sequence
  Description of Artificial Sequence: Synthetic oligonucleotide
tggactccccggggagtccacg

SEQ ID NO: 8116 - DNA, 22 bp, Artificial Sequence
  Description of Artificial Sequence: Synthetic oligonucleotide
ccgactccccggggagtcggtg

SEQ ID NO: 8117 - DNA, 22 bp, Artificial Sequence
  Description of Artificial Sequence: Synthetic oligonucleotide
ccgactccccggggagtcggag

SEQ ID NO: 8118 - DNA, 22 bp, Artificial Sequence
  Description of Artificial Sequence: Synthetic oligonucleotide
gggactccccggggagtcccgc

SEQ ID NO: 8119 - DNA, 22 bp, Artificial Sequence
  Description of Artificial Sequence: Synthetic oligonucleotide
gggactccccggggagtccctc

SEQ ID NO: 8120 - DNA, 22 bp, Artificial Sequence
  Description of Artificial Sequence: Synthetic oligonucleotide
gggactccccggggagtcccac

SEQ ID NO: 8121 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgtatacgagtcnnnn

SEQ ID NO: 8122 - DNA, 22 bp, Artificial Sequence
  Description of Artificial Sequence: Synthetic oligonucleotide
cggactcgtatacgagtccgcc

SEQ ID NO: 8123 - DNA, 22 bp, Artificial Sequence
  Description of Artificial Sequence: Synthetic oligonucleotide
cggactcgtatacgagtccgct

SEQ ID NO: 8124 - DNA, 22 bp, Artificial Sequence
  Description of Artificial Sequence: Synthetic oligonucleotide
cggactcgtatacgagtccgtc

SEQ ID NO: 8125 - DNA, 22 bp, Artificial Sequence
  Description of Artificial Sequence: Synthetic oligonucleotide
aggactcgtatacgagtcctcc

SEQ ID NO: 8126 - DNA, 22 bp, Artificial Sequence
  Description of Artificial Sequence: Synthetic oligonucleotide
cagactcgtatacgagtctgcc

SEQ ID NO: 8127 - DNA, 22 bp, Artificial Sequence
  Description of Artificial Sequence: Synthetic oligonucleotide
cggactcgtatacgagtccgca

SEQ ID NO: 8128 - DNA, 22 bp, Artificial Sequence
  Description of Artificial Sequence: Synthetic oligonucleotide
cggactcgtatacgagtccgac

SEQ ID NO: 8129 - DNA, 22 bp, Artificial Sequence
  Description of Artificial Sequence: Synthetic oligonucleotide
tggactcgtatacgagtccacc

SEQ ID NO: 8130 - DNA, 22 bp, Artificial Sequence
  Description of Artificial Sequence: Synthetic oligonucleotide
ctgactcgtatacgagtcagcc

SEQ ID NO: 8131 - DNA, 22 bp, Artificial Sequence
  Description of Artificial Sequence: Synthetic oligonucleotide
ccgactcgtatacgagtcgggc

SEQ ID NO: 8132 - DNA, 22 bp, Artificial Sequence
  Description of Artificial Sequence: Synthetic oligonucleotide
ccgactcgtatacgagtcgggt

SEQ ID NO: 8133 - DNA, 22 bp, Artificial Sequence
  Description of Artificial Sequence: Synthetic oligonucleotide
ccgactcgtatacgagtcggtc

SEQ ID NO: 8134 - DNA, 22 bp, Artificial Sequence
  Description of Artificial Sequence: Synthetic oligonucleotide
acgactcgtatacgagtcgtgc

SEQ ID NO: 8135 - DNA, 22 bp, Artificial Sequence
  Description of Artificial Sequence: Synthetic oligonucleotide
cagactcgtatacgagtctggc

SEQ ID NO: 8136 - DNA, 22 bp, Artificial Sequence
  Description of Artificial Sequence: Synthetic oligonucleotide
ccgactcgtatacgagtcggga

SEQ ID NO: 8137 - DNA, 22 bp, Artificial Sequence
  Description of Artificial Sequence: Synthetic oligonucleotide
ccgactcgtatacgagtcggac

SEQ ID NO: 8138 - DNA, 22 bp, Artificial Sequence
  Description of Artificial Sequence: Synthetic oligonucleotide
ctgactcgtatacgagtcaggc

SEQ ID NO: 8139 - DNA, 22 bp, Artificial Sequence
  Description of Artificial Sequence: Synthetic oligonucleotide
gcgactcgtatacgagtcgccc

SEQ ID NO: 8140 - DNA, 22 bp, Artificial Sequence
  Description of Artificial Sequence: Synthetic oligonucleotide
gcgactcgtatacgagtcgcct

SEQ ID NO: 8141 - DNA, 22 bp, Artificial Sequence
  Description of Artificial Sequence: Synthetic oligonucleotide
gcgactcgtatacgagtcgctc

SEQ ID NO: 8142 - DNA, 22 bp, Artificial Sequence
  Description of Artificial Sequence: Synthetic oligonucleotide
acgactcgtatacgagtcgtcc

SEQ ID NO: 8143 - DNA, 22 bp, Artificial Sequence
  Description of Artificial Sequence: Synthetic oligonucleotide
gagactcgtatacgagtctccc

SEQ ID NO: 8144 - DNA, 22 bp, Artificial Sequence
  Description of Artificial Sequence: Synthetic oligonucleotide
gcgactcgtatacgagtcgcca

SEQ ID NO: 8145 - DNA, 22 bp, Artificial Sequence
  Description of Artificial Sequence: Synthetic oligonucleotide
gcgactcgtatacgagtcgcac

SEQ ID NO: 8146 - DNA, 22 bp, Artificial Sequence
  Description of Artificial Sequence: Synthetic oligonucleotide
gtgactcgtatacgagtcaccc

SEQ ID NO: 8147 - DNA, 22 bp, Artificial Sequence
  Description of Artificial Sequence: Synthetic oligonucleotide
gggactcgtatacgagtcccgt

SEQ ID NO: 8148 - DNA, 22 bp, Artificial Sequence
  Description of Artificial Sequence: Synthetic oligonucleotide
gggactcgtatacgagtccctg

SEQ ID NO: 8149 - DNA, 22 bp, Artificial Sequence
  Description of Artificial Sequence: Synthetic oligonucleotide
aggactcgtatacgagtcctgg

SEQ ID NO: 8150 - DNA, 22 bp, Artificial Sequence
  Description of Artificial Sequence: Synthetic oligonucleotide
gagactcgtatacgagtctcgg

SEQ ID NO: 8151 - DNA, 22 bp, Artificial Sequence
  Description of Artificial Sequence: Synthetic oligonucleotide
gggactcgtatacgagtcccga

SEQ ID NO: 8152 - DNA, 22 bp, Artificial Sequence
  Description of Artificial Sequence: Synthetic oligonucleotide
gggactcgtatacgagtcccag

SEQ ID NO: 8153 - DNA, 22 bp, Artificial Sequence
  Description of Artificial Sequence: Synthetic oligonucleotide
tggactcgtatacgagtccagg

SEQ ID NO: 8154 - DNA, 22 bp, Artificial Sequence
  Description of Artificial Sequence: Synthetic oligonucleotide
gtgactcgtatacgagtcacgg

SEQ ID NO: 8155 - DNA, 22 bp, Artificial Sequence
  Description of Artificial Sequence: Synthetic oligonucleotide
gcgactcgtatacgagtcgccg

SEQ ID NO: 8156 - DNA, 22 bp, Artificial Sequence
  Description of Artificial Sequence: Synthetic oligonucleotide
gcgactcgtatacgagtcgctg

SEQ ID NO: 8157 - DNA, 22 bp, Artificial Sequence
  Description of Artificial Sequence: Synthetic oligonucleotide
acgactcgtatacgagtcgtcg

SEQ ID NO: 8158 - DNA, 22 bp, Artificial Sequence
  Description of Artificial Sequence: Synthetic oligonucleotide
gagactcgtatacgagtctccg

SEQ ID NO: 8159 - DNA, 22 bp, Artificial Sequence
  Description of Artificial Sequence: Synthetic oligonucleotide
gcgactcgtatacgagtcgcag

SEQ ID NO: 8160 - DNA, 22 bp, Artificial Sequence
  Description of Artificial Sequence: Synthetic oligonucleotide
gtgactcgtatacgagtcaccg

SEQ ID NO: 8161 - DNA, 22 bp, Artificial Sequence
  Description of Artificial Sequence: Synthetic oligonucleotide
cggactcgtatacgagtccgtg

SEQ ID NO: 8162 - DNA, 22 bp, Artificial Sequence
  Description of Artificial Sequence: Synthetic oligonucleotide
cagactcgtatacgagtctggg

SEQ ID NO: 8163 - DNA, 22 bp, Artificial Sequence
  Description of Artificial Sequence: Synthetic oligonucleotide
cggactcgtatacgagtccgag

SEQ ID NO: 8164 - DNA, 22 bp, Artificial Sequence
  Description of Artificial Sequence: Synthetic oligonucleotide
ctgactcgtatacgagtcaggg

SEQ ID NO: 8165 - DNA, 22 bp, Artificial Sequence
  Description of Artificial Sequence: Synthetic oligonucleotide
acgactcgtatacgagtcgtgg

SEQ ID NO: 8166 - DNA, 22 bp, Artificial Sequence
  Description of Artificial Sequence: Synthetic oligonucleotide
ccgactcgtatacgagtcggct

SEQ ID NO: 8167 - DNA, 22 bp, Artificial Sequence
  Description of Artificial Sequence: Synthetic oligonucleotide
ccgactcgtatacgagtcggca

SEQ ID NO: 8168 - DNA, 22 bp, Artificial Sequence
  Description of Artificial Sequence: Synthetic oligonucleotide
gagactcgtatacgagtctcgc

SEQ ID NO: 8169 - DNA, 22 bp, Artificial Sequence
  Description of Artificial Sequence: Synthetic oligonucleotide
gtgactcgtatacgagtcacgc

SEQ ID NO: 8170 - DNA, 22 bp, Artificial Sequence
  Description of Artificial Sequence: Synthetic oligonucleotide
aggactcgtatacgagtcctgc

SEQ ID NO: 8171 - DNA, 22 bp, Artificial Sequence
  Description of Artificial Sequence: Synthetic oligonucleotide
tggactcgtatacgagtccagc

SEQ ID NO: 8172 - DNA, 22 bp, Artificial Sequence
  Description of Artificial Sequence: Synthetic oligonucleotide
aggactcgtatacgagtcctcg

SEQ ID NO: 8173 - DNA, 22 bp, Artificial Sequence
  Description of Artificial Sequence: Synthetic oligonucleotide
tggactcgtatacgagtccacg

SEQ ID NO: 8174 - DNA, 22 bp, Artificial Sequence
  Description of Artificial Sequence: Synthetic oligonucleotide
ccgactcgtatacgagtcggtg

SEQ ID NO: 8175 - DNA, 22 bp, Artificial Sequence
  Description of Artificial Sequence: Synthetic oligonucleotide
ccgactcgtatacgagtcggag

SEQ ID NO: 8176 - DNA, 22 bp, Artificial Sequence
  Description of Artificial Sequence: Synthetic oligonucleotide
gggactcgtatacgagtcccgc

SEQ ID NO: 8177 - DNA, 22 bp, Artificial Sequence
  Description of Artificial Sequence: Synthetic oligonucleotide
gggactcgtatacgagtccctc

SEQ ID NO: 8178 - DNA, 22 bp, Artificial Sequence
  Description of Artificial Sequence: Synthetic oligonucleotide
gggactcgtatacgagtcccac

SEQ ID NO: 8179 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgttaacgagtcnnnn

SEQ ID NO: 8180 - DNA, 22 bp, Artificial Sequence
  Description of Artificial Sequence: Synthetic oligonucleotide
cggactcgttaacgagtccgcc

SEQ ID NO: 8181 - DNA, 22 bp, Artificial Sequence
  Description of Artificial Sequence: Synthetic oligonucleotide
cggactcgttaacgagtccgct

SEQ ID NO: 8182 - DNA, 22 bp, Artificial Sequence
  Description of Artificial Sequence: Synthetic oligonucleotide
cggactcgttaacgagtccgtc

SEQ ID NO: 8183 - DNA, 22 bp, Artificial Sequence
  Description of Artificial Sequence: Synthetic oligonucleotide
aggactcgttaacgagtcctcc

SEQ ID NO: 8184 - DNA, 22 bp, Artificial Sequence
  Description of Artificial Sequence: Synthetic oligonucleotide
cagactcgttaacgagtctgcc

SEQ ID NO: 8185 - DNA, 22 bp, Artificial Sequence
  Description of Artificial Sequence: Synthetic oligonucleotide
cggactcgttaacgagtccgca

SEQ ID NO: 8186 - DNA, 22 bp, Artificial Sequence
  Description of Artificial Sequence: Synthetic oligonucleotide
cggactcgttaacgagtccgac

SEQ ID NO: 8187 - DNA, 22 bp, Artificial Sequence
  Description of Artificial Sequence: Synthetic oligonucleotide
tggactcgttaacgagtccacc

SEQ ID NO: 8188 - DNA, 22 bp, Artificial Sequence
  Description of Artificial Sequence: Synthetic oligonucleotide
ctgactcgttaacgagtcagcc

SEQ ID NO: 8189 - DNA, 22 bp, Artificial Sequence
  Description of Artificial Sequence: Synthetic oligonucleotide
ccgactcgttaacgagtcgggc

SEQ ID NO: 8190 - DNA, 22 bp, Artificial Sequence
  Description of Artificial Sequence: Synthetic oligonucleotide
ccgactcgttaacgagtcgggt

SEQ ID NO: 8191 - DNA, 22 bp, Artificial Sequence
  Description of Artificial Sequence: Synthetic oligonucleotide
ccgactcgttaacgagtcggtc

SEQ ID NO: 8192 - DNA, 22 bp, Artificial Sequence
  Description of Artificial Sequence: Synthetic oligonucleotide
acgactcgttaacgagtcgtgc

SEQ ID NO: 8193 - DNA, 22 bp, Artificial Sequence
  Description of Artificial Sequence: Synthetic oligonucleotide
cagactcgttaacgagtctggc

SEQ ID NO: 8194 - DNA, 22 bp, Artificial Sequence
  Description of Artificial Sequence: Synthetic oligonucleotide
ccgactcgttaacgagtcggga

SEQ ID NO: 8195 - DNA, 22 bp, Artificial Sequence
  Description of Artificial Sequence: Synthetic oligonucleotide
ccgactcgttaacgagtcggac

SEQ ID NO: 8196 - DNA, 22 bp, Artificial Sequence
  Description of Artificial Sequence: Synthetic oligonucleotide
ctgactcgttaacgagtcaggc

SEQ ID NO: 8197 - DNA, 22 bp, Artificial Sequence
  Description of Artificial Sequence: Synthetic oligonucleotide
gcgactcgttaacgagtcgccc

SEQ ID NO: 8198 - DNA, 22 bp, Artificial Sequence
  Description of Artificial Sequence: Synthetic oligonucleotide
gcgactcgttaacgagtcgcct

SEQ ID NO: 8199 - DNA, 22 bp, Artificial Sequence
  Description of Artificial Sequence: Synthetic oligonucleotide
gcgactcgttaacgagtcgctc

SEQ ID NO: 8200 - DNA, 22 bp, Artificial Sequence
  Description of Artificial Sequence: Synthetic oligonucleotide
acgactcgttaacgagtcgtcc

SEQ ID NO: 8201 - DNA, 22 bp, Artificial Sequence
  Description of Artificial Sequence: Synthetic oligonucleotide
gagactcgttaacgagtctccc

SEQ ID NO: 8202 - DNA, 22 bp, Artificial Sequence
  Description of Artificial Sequence: Synthetic oligonucleotide
gcgactcgttaacgagtcgcca

SEQ ID NO: 8203 - DNA, 22 bp, Artificial Sequence
  Description of Artificial Sequence: Synthetic oligonucleotide
gcgactcgttaacgagtcgcac

SEQ ID NO: 8204 - DNA, 22 bp, Artificial Sequence
  Description of Artificial Sequence: Synthetic oligonucleotide
gtgactcgttaacgagtcaccc

SEQ ID NO: 8205 - DNA, 22 bp, Artificial Sequence
  Description of Artificial Sequence: Synthetic oligonucleotide
gggactcgttaacgagtcccgt

SEQ ID NO: 8206 - DNA, 22 bp, Artificial Sequence
  Description of Artificial Sequence: Synthetic oligonucleotide
gggactcgttaacgagtccctg

SEQ ID NO: 8207 - DNA, 22 bp, Artificial Sequence
  Description of Artificial Sequence: Synthetic oligonucleotide
aggactcgttaacgagtcctgg

SEQ ID NO: 8208 - DNA, 22 bp, Artificial Sequence
  Description of Artificial Sequence: Synthetic oligonucleotide
gagactcgttaacgagtctcgg

SEQ ID NO: 8209 - DNA, 22 bp, Artificial Sequence
  Description of Artificial Sequence: Synthetic oligonucleotide
gggactcgttaacgagtcccga

SEQ ID NO: 8210 - DNA, 22 bp, Artificial Sequence
  Description of Artificial Sequence: Synthetic oligonucleotide
gggactcgttaacgagtcccag

SEQ ID NO: 8211 - DNA, 22 bp, Artificial Sequence
  Description of Artificial Sequence: Synthetic oligonucleotide
tggactcgttaacgagtccagg

SEQ ID NO: 8212 - DNA, 22 bp, Artificial Sequence
  Description of Artificial Sequence: Synthetic oligonucleotide
gtgactcgttaacgagtcacgg

SEQ ID NO: 8213 - DNA, 22 bp, Artificial Sequence
  Description of Artificial Sequence: Synthetic oligonucleotide
gcgactcgttaacgagtcgccg

SEQ ID NO: 8214 - DNA, 22 bp, Artificial Sequence
  Description of Artificial Sequence: Synthetic oligonucleotide
gcgactcgttaacgagtcgctg

SEQ ID NO: 8215 - DNA, 22 bp, Artificial Sequence
  Description of Artificial Sequence: Synthetic oligonucleotide
acgactcgttaacgagtcgtcg

SEQ ID NO: 8216 - DNA, 22 bp, Artificial Sequence
  Description of Artificial Sequence: Synthetic oligonucleotide
gagactcgttaacgagtctccg

SEQ ID NO: 8217 - DNA, 22 bp, Artificial Sequence
  Description of Artificial Sequence: Synthetic oligonucleotide
gcgactcgttaacgagtcgcag

SEQ ID NO: 8218 - DNA, 22 bp, Artificial Sequence
  Description of Artificial Sequence: Synthetic oligonucleotide
gtgactcgttaacgagtcaccg

SEQ ID NO: 8219 - DNA, 22 bp, Artificial Sequence
  Description of Artificial Sequence: Synthetic oligonucleotide
cggactcgttaacgagtccgtg

SEQ ID NO: 8220 - DNA, 22 bp, Artificial Sequence
  Description of Artificial Sequence: Synthetic oligonucleotide
cagactcgttaacgagtctggg

SEQ ID NO: 8221 - DNA, 22 bp, Artificial Sequence
  Description of Artificial Sequence: Synthetic oligonucleotide
cggactcgttaacgagtccgag

SEQ ID NO: 8222 - DNA, 22 bp, Artificial Sequence
  Description of Artificial Sequence: Synthetic oligonucleotide
ctgactcgttaacgagtcaggg

SEQ ID NO: 8223 - DNA, 22 bp, Artificial Sequence
  Description of Artificial Sequence: Synthetic oligonucleotide
acgactcgttaacgagtcgtgg

SEQ ID NO: 8224 - DNA, 22 bp, Artificial Sequence
  Description of Artificial Sequence: Synthetic oligonucleotide
ccgactcgttaacgagtcggct

SEQ ID NO: 8225 - DNA, 22 bp, Artificial Sequence
  Description of Artificial Sequence: Synthetic oligonucleotide
ccgactcgttaacgagtcggca

SEQ ID NO: 8226 - DNA, 22 bp, Artificial Sequence
  Description of Artificial Sequence: Synthetic oligonucleotide
gagactcgttaacgagtctcgc

SEQ ID NO: 8227 - DNA, 22 bp, Artificial Sequence
  Description of Artificial Sequence: Synthetic oligonucleotide
gtgactcgttaacgagtcacgc

SEQ ID NO: 8228 - DNA, 22 bp, Artificial Sequence
  Description of Artificial Sequence: Synthetic oligonucleotide
aggactcgttaacgagtcctgc

SEQ ID NO: 8229 - DNA, 22 bp, Artificial Sequence
  Description of Artificial Sequence: Synthetic oligonucleotide
tggactcgttaacgagtccagc

SEQ ID NO: 8230 - DNA, 22 bp, Artificial Sequence
  Description of Artificial Sequence: Synthetic oligonucleotide
aggactcgttaacgagtcctcg

SEQ ID NO: 8231 - DNA, 22 bp, Artificial Sequence
  Description of Artificial Sequence: Synthetic oligonucleotide
tggactcgttaacgagtccacg

SEQ ID NO: 8232 - DNA, 22 bp, Artificial Sequence
  Description of Artificial Sequence: Synthetic oligonucleotide
ccgactcgttaacgagtcggtg

SEQ ID NO: 8233 - DNA, 22 bp, Artificial Sequence
  Description of Artificial Sequence: Synthetic oligonucleotide
ccgactcgttaacgagtcggag

SEQ ID NO: 8234 - DNA, 22 bp, Artificial Sequence
  Description of Artificial Sequence: Synthetic oligonucleotide
gggactcgttaacgagtcccgc

SEQ ID NO: 8235 - DNA, 22 bp, Artificial Sequence
  Description of Artificial Sequence: Synthetic oligonucleotide
gggactcgttaacgagtccctc

SEQ ID NO: 8236 - DNA, 22 bp, Artificial Sequence
  Description of Artificial Sequence: Synthetic oligonucleotide
gggactcgttaacgagtcccac

SEQ ID NO: 8237 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgtgcacgagtcnnnn

SEQ ID NO: 8238 - DNA, 22 bp, Artificial Sequence
  Description of Artificial Sequence: Synthetic oligonucleotide
cggactcgtgcacgagtccgcc

SEQ ID NO: 8239 - DNA, 22 bp, Artificial Sequence
  Description of Artificial Sequence: Synthetic oligonucleotide
cggactcgtgcacgagtccgct

SEQ ID NO: 8240 - DNA, 22 bp, Artificial Sequence
  Description of Artificial Sequence: Synthetic oligonucleotide
cggactcgtgcacgagtccgtc

SEQ ID NO: 8241 - DNA, 22 bp, Artificial Sequence
  Description of Artificial Sequence: Synthetic oligonucleotide
aggactcgtgcacgagtcctcc

SEQ ID NO: 8242 - DNA, 22 bp, Artificial Sequence
  Description of Artificial Sequence: Synthetic oligonucleotide
cagactcgtgcacgagtctgcc

SEQ ID NO: 8243 - DNA, 22 bp, Artificial Sequence
  Description of Artificial Sequence: Synthetic oligonucleotide
cggactcgtgcacgagtccgca

SEQ ID NO: 8244 - DNA, 22 bp, Artificial Sequence
  Description of Artificial Sequence: Synthetic oligonucleotide
cggactcgtgcacgagtccgac

SEQ ID NO: 8245 - DNA, 22 bp, Artificial Sequence
  Description of Artificial Sequence: Synthetic oligonucleotide
tggactcgtgcacgagtccacc

SEQ ID NO: 8246 - DNA, 22 bp, Artificial Sequence
  Description of Artificial Sequence: Synthetic oligonucleotide
ctgactcgtgcacgagtcagcc

SEQ ID NO: 8247 - DNA, 22 bp, Artificial Sequence
  Description of Artificial Sequence: Synthetic oligonucleotide
ccgactcgtgcacgagtcgggc

SEQ ID NO: 8248 - DNA, 22 bp, Artificial Sequence
  Description of Artificial Sequence: Synthetic oligonucleotide
ccgactcgtgcacgagtcgggt

SEQ ID NO: 8249 - DNA, 22 bp, Artificial Sequence
  Description of Artificial Sequence: Synthetic oligonucleotide
ccgactcgtgcacgagtcggtc

SEQ ID NO: 8250 - DNA, 22 bp, Artificial Sequence
  Description of Artificial Sequence: Synthetic oligonucleotide
acgactcgtgcacgagtcgtgc

SEQ ID NO: 8251 - DNA, 22 bp, Artificial Sequence
  Description of Artificial Sequence: Synthetic oligonucleotide
cagactcgtgcacgagtctggc

SEQ ID NO: 8252 - DNA, 22 bp, Artificial Sequence
  Description of Artificial Sequence: Synthetic oligonucleotide
ccgactcgtgcacgagtcggga

SEQ ID NO: 8253 - DNA, 22 bp, Artificial Sequence
  Description of Artificial Sequence: Synthetic oligonucleotide
ccgactcgtgcacgagtcggac

SEQ ID NO: 8254 - DNA, 22 bp, Artificial Sequence
  Description of Artificial Sequence: Synthetic oligonucleotide
ctgactcgtgcacgagtcaggc

SEQ ID NO: 8255 - DNA, 22 bp, Artificial Sequence
  Description of Artificial Sequence: Synthetic oligonucleotide
gcgactcgtgcacgagtcgccc

SEQ ID NO: 8256 - DNA, 22 bp, Artificial Sequence
  Description of Artificial Sequence: Synthetic oligonucleotide
gcgactcgtgcacgagtcgcct

SEQ ID NO: 8257 - DNA, 22 bp, Artificial Sequence
  Description of Artificial Sequence: Synthetic oligonucleotide
gcgactcgtgcacgagtcgctc

SEQ ID NO: 8258 - DNA, 22 bp, Artificial Sequence
  Description of Artificial Sequence: Synthetic oligonucleotide
acgactcgtgcacgagtcgtcc

SEQ ID NO: 8259 - DNA, 22 bp, Artificial Sequence
  Description of Artificial Sequence: Synthetic oligonucleotide
gagactcgtgcacgagtctccc

SEQ ID NO: 8260 - DNA, 22 bp, Artificial Sequence
  Description of Artificial Sequence: Synthetic oligonucleotide
gcgactcgtgcacgagtcgcca

SEQ ID NO: 8261 - DNA, 22 bp, Artificial Sequence
  Description of Artificial Sequence: Synthetic oligonucleotide
gcgactcgtgcacgagtcgcac

SEQ ID NO: 8262 - DNA, 22 bp, Artificial Sequence
  Description of Artificial Sequence: Synthetic oligonucleotide
gtgactcgtgcacgagtcaccc

SEQ ID NO: 8263 - DNA, 22 bp, Artificial Sequence
  Description of Artificial Sequence: Synthetic oligonucleotide
gggactcgtgcacgagtcccgt

SEQ ID NO: 8264 - DNA, 22 bp, Artificial Sequence
  Description of Artificial Sequence: Synthetic oligonucleotide
gggactcgtgcacgagtccctg

SEQ ID NO: 8265 - DNA, 22 bp, Artificial Sequence
  Description of Artificial Sequence: Synthetic oligonucleotide
aggactcgtgcacgagtcctgg

SEQ ID NO: 8266 - DNA, 22 bp, Artificial Sequence
  Description of Artificial Sequence: Synthetic oligonucleotide
gagactcgtgcacgagtctcgg

SEQ ID NO: 8267 - DNA, 22 bp, Artificial Sequence
  Description of Artificial Sequence: Synthetic oligonucleotide
gggactcgtgcacgagtcccga

SEQ ID NO: 8268 - DNA, 22 bp, Artificial Sequence
  Description of Artificial Sequence: Synthetic oligonucleotide
gggactcgtgcacgagtcccag

SEQ ID NO: 8269 - DNA, 22 bp, Artificial Sequence
  Description of Artificial Sequence: Synthetic oligonucleotide
tggactcgtgcacgagtccagg

SEQ ID NO: 8270 - DNA, 22 bp, Artificial Sequence
  Description of Artificial Sequence: Synthetic oligonucleotide
gtgactcgtgcacgagtcacgg

SEQ ID NO: 8271 - DNA, 22 bp, Artificial Sequence
  Description of Artificial Sequence: Synthetic oligonucleotide
gcgactcgtgcacgagtcgccg

SEQ ID NO: 8272 - DNA, 22 bp, Artificial Sequence
  Description of Artificial Sequence: Synthetic oligonucleotide
gcgactcgtgcacgagtcgctg

SEQ ID NO: 8273 - DNA, 22 bp, Artificial Sequence
  Description of Artificial Sequence: Synthetic oligonucleotide
acgactcgtgcacgagtcgtcg

SEQ ID NO: 8274 - DNA, 22 bp, Artificial Sequence
  Description of Artificial Sequence: Synthetic oligonucleotide
gagactcgtgcacgagtctccg

SEQ ID NO: 8275 - DNA, 22 bp, Artificial Sequence
  Description of Artificial Sequence: Synthetic oligonucleotide
gcgactcgtgcacgagtcgcag

SEQ ID NO: 8276 - DNA, 22 bp, Artificial Sequence
  Description of Artificial Sequence: Synthetic oligonucleotide
gtgactcgtgcacgagtcaccg

SEQ ID NO: 8277 - DNA, 22 bp, Artificial Sequence
  Description of Artificial Sequence: Synthetic oligonucleotide
cggactcgtgcacgagtccgtg

SEQ ID NO: 8278 - DNA, 22 bp, Artificial Sequence
  Description of Artificial Sequence: Synthetic oligonucleotide
cagactcgtgcacgagtctggg

SEQ ID NO: 8279 - DNA, 22 bp, Artificial Sequence
  Description of Artificial Sequence: Synthetic oligonucleotide
cggactcgtgcacgagtccgag

SEQ ID NO: 8280 - DNA, 22 bp, Artificial Sequence
  Description of Artificial Sequence: Synthetic oligonucleotide
ctgactcgtgcacgagtcaggg

SEQ ID NO: 8281 - DNA, 22 bp, Artificial Sequence
  Description of Artificial Sequence: Synthetic oligonucleotide
acgactcgtgcacgagtcgtgg

SEQ ID NO: 8282 - DNA, 22 bp, Artificial Sequence
  Description of Artificial Sequence: Synthetic oligonucleotide
ccgactcgtgcacgagtcggct

SEQ ID NO: 8283 - DNA, 22 bp, Artificial Sequence
  Description of Artificial Sequence: Synthetic oligonucleotide
ccgactcgtgcacgagtcggca

SEQ ID NO: 8284 - DNA, 22 bp, Artificial Sequence
  Description of Artificial Sequence: Synthetic oligonucleotide
gagactcgtgcacgagtctcgc

SEQ ID NO: 8285 - DNA, 22 bp, Artificial Sequence
  Description of Artificial Sequence: Synthetic oligonucleotide
gtgactcgtgcacgagtcacgc

SEQ ID NO: 8286 - DNA, 22 bp, Artificial Sequence
  Description of Artificial Sequence: Synthetic oligonucleotide
aggactcgtgcacgagtcctgc

SEQ ID NO: 8287 - DNA, 22 bp, Artificial Sequence
  Description of Artificial Sequence: Synthetic oligonucleotide
tggactcgtgcacgagtccagc

SEQ ID NO: 8288 - DNA, 22 bp, Artificial Sequence
  Description of Artificial Sequence: Synthetic oligonucleotide
aggactcgtgcacgagtcctcg

SEQ ID NO: 8289 - DNA, 22 bp, Artificial Sequence
  Description of Artificial Sequence: Synthetic oligonucleotide
tggactcgtgcacgagtccacg

SEQ ID NO: 8290 - DNA, 22 bp, Artificial Sequence
  Description of Artificial Sequence: Synthetic oligonucleotide
ccgactcgtgcacgagtcggtg

SEQ ID NO: 8291 - DNA, 22 bp, Artificial Sequence
  Description of Artificial Sequence: Synthetic oligonucleotide
ccgactcgtgcacgagtcggag

SEQ ID NO: 8292 - DNA, 22 bp, Artificial Sequence
  Description of Artificial Sequence: Synthetic oligonucleotide
gggactcgtgcacgagtcccgc

SEQ ID NO: 8293 - DNA, 22 bp, Artificial Sequence
  Description of Artificial Sequence: Synthetic oligonucleotide
gggactcgtgcacgagtccctc

SEQ ID NO: 8294 - DNA, 22 bp, Artificial Sequence
  Description of Artificial Sequence: Synthetic oligonucleotide
gggactcgtgcacgagtcccac

SEQ ID NO: 8295 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcgtcgacgagtcnnnn

SEQ ID NO: 8296 - DNA, 22 bp, Artificial Sequence
  Description of Artificial Sequence: Synthetic oligonucleotide
cggactcgtcgacgagtccgcc

SEQ ID NO: 8297 - DNA, 22 bp, Artificial Sequence
  Description of Artificial Sequence: Synthetic oligonucleotide
cggactcgtcgacgagtccgct

SEQ ID NO: 8298 - DNA, 22 bp, Artificial Sequence
  Description of Artificial Sequence: Synthetic oligonucleotide
cggactcgtcgacgagtccgtc

SEQ ID NO: 8299 - DNA, 22 bp, Artificial Sequence
  Description of Artificial Sequence: Synthetic oligonucleotide
aggactcgtcgacgagtcctcc

SEQ ID NO: 8300 - DNA, 22 bp, Artificial Sequence
  Description of Artificial Sequence: Synthetic oligonucleotide
cagactcgtcgacgagtctgcc

SEQ ID NO: 8301 - DNA, 22 bp, Artificial Sequence
  Description of Artificial Sequence: Synthetic oligonucleotide
cggactcgtcgacgagtccgca

SEQ ID NO: 8302 - DNA, 22 bp, Artificial Sequence
  Description of Artificial Sequence: Synthetic oligonucleotide
cggactcgtcgacgagtccgac

SEQ ID NO: 8303 - DNA, 22 bp, Artificial Sequence
  Description of Artificial Sequence: Synthetic oligonucleotide
tggactcgtcgacgagtccacc

SEQ ID NO: 8304 - DNA, 22 bp, Artificial Sequence
  Description of Artificial Sequence: Synthetic oligonucleotide
ctgactcgtcgacgagtcagcc

SEQ ID NO: 8305 - DNA, 22 bp, Artificial Sequence
  Description of Artificial Sequence: Synthetic oligonucleotide
ccgactcgtcgacgagtcgggc

SEQ ID NO: 8306 - DNA, 22 bp, Artificial Sequence
  Description of Artificial Sequence: Synthetic oligonucleotide
ccgactcgtcgacgagtcgggt

SEQ ID NO: 8307 - DNA, 22 bp, Artificial Sequence
  Description of Artificial Sequence: Synthetic oligonucleotide
ccgactcgtcgacgagtcggtc

SEQ ID NO: 8308 - DNA, 22 bp, Artificial Sequence
  Description of Artificial Sequence: Synthetic oligonucleotide
acgactcgtcgacgagtcgtgc

SEQ ID NO: 8309 - DNA, 22 bp, Artificial Sequence
  Description of Artificial Sequence: Synthetic oligonucleotide
cagactcgtcgacgagtctggc

SEQ ID NO: 8310 - DNA, 22 bp, Artificial Sequence
  Description of Artificial Sequence: Synthetic oligonucleotide
ccgactcgtcgacgagtcggga

SEQ ID NO: 8311 - DNA, 22 bp, Artificial Sequence
  Description of Artificial Sequence: Synthetic oligonucleotide
ccgactcgtcgacgagtcggac

SEQ ID NO: 8312 - DNA, 22 bp, Artificial Sequence
  Description of Artificial Sequence: Synthetic oligonucleotide
ctgactcgtcgacgagtcaggc

SEQ ID NO: 8313 - DNA, 22 bp, Artificial Sequence
  Description of Artificial Sequence: Synthetic oligonucleotide
gcgactcgtcgacgagtcgccc

SEQ ID NO: 8314 - DNA, 22 bp, Artificial Sequence
  Description of Artificial Sequence: Synthetic oligonucleotide
gcgactcgtcgacgagtcgcct

SEQ ID NO: 8315 - DNA, 22 bp, Artificial Sequence
  Description of Artificial Sequence: Synthetic oligonucleotide
gcgactcgtcgacgagtcgctc

SEQ ID NO: 8316 - DNA, 22 bp, Artificial Sequence
  Description of Artificial Sequence: Synthetic oligonucleotide
acgactcgtcgacgagtcgtcc

SEQ ID NO: 8317 - DNA, 22 bp, Artificial Sequence
  Description of Artificial Sequence: Synthetic oligonucleotide
gagactcgtcgacgagtctccc

SEQ ID NO: 8318 - DNA, 22 bp, Artificial Sequence
  Description of Artificial Sequence: Synthetic oligonucleotide
gcgactcgtcgacgagtcgcca

SEQ ID NO: 8319 - DNA, 22 bp, Artificial Sequence
  Description of Artificial Sequence: Synthetic oligonucleotide
gcgactcgtcgacgagtcgcac

SEQ ID NO: 8320 - DNA, 22 bp, Artificial Sequence
  Description of Artificial Sequence: Synthetic oligonucleotide
gtgactcgtcgacgagtcaccc

SEQ ID NO: 8321 - DNA, 22 bp, Artificial Sequence
  Description of Artificial Sequence: Synthetic oligonucleotide
gggactcgtcgacgagtcccgt

SEQ ID NO: 8322 - DNA, 22 bp, Artificial Sequence
  Description of Artificial Sequence: Synthetic oligonucleotide
gggactcgtcgacgagtccctg

SEQ ID NO: 8323 - DNA, 22 bp, Artificial Sequence
  Description of Artificial Sequence: Synthetic oligonucleotide
aggactcgtcgacgagtcctgg

SEQ ID NO: 8324 - DNA, 22 bp, Artificial Sequence
  Description of Artificial Sequence: Synthetic oligonucleotide
gagactcgtcgacgagtctcgg

SEQ ID NO: 8325 - DNA, 22 bp, Artificial Sequence
  Description of Artificial Sequence: Synthetic oligonucleotide
gggactcgtcgacgagtcccga

SEQ ID NO: 8326 - DNA, 22 bp, Artificial Sequence
  Description of Artificial Sequence: Synthetic oligonucleotide
gggactcgtcgacgagtcccag

SEQ ID NO: 8327 - DNA, 22 bp, Artificial Sequence
  Description of Artificial Sequence: Synthetic oligonucleotide
tggactcgtcgacgagtccagg

SEQ ID NO: 8328 - DNA, 22 bp, Artificial Sequence
  Description of Artificial Sequence: Synthetic oligonucleotide
gtgactcgtcgacgagtcacgg

SEQ ID NO: 8329 - DNA, 22 bp, Artificial Sequence
  Description of Artificial Sequence: Synthetic oligonucleotide
gcgactcgtcgacgagtcgccg

SEQ ID NO: 8330 - DNA, 22 bp, Artificial Sequence
  Description of Artificial Sequence: Synthetic oligonucleotide
gcgactcgtcgacgagtcgctg

SEQ ID NO: 8331 - DNA, 22 bp, Artificial Sequence
  Description of Artificial Sequence: Synthetic oligonucleotide
acgactcgtcgacgagtcgtcg

SEQ ID NO: 8332 - DNA, 22 bp, Artificial Sequence
  Description of Artificial Sequence: Synthetic oligonucleotide
gagactcgtcgacgagtctccg

SEQ ID NO: 8333 - DNA, 22 bp, Artificial Sequence
  Description of Artificial Sequence: Synthetic oligonucleotide
gcgactcgtcgacgagtcgcag

SEQ ID NO: 8334 - DNA, 22 bp, Artificial Sequence
  Description of Artificial Sequence: Synthetic oligonucleotide
gtgactcgtcgacgagtcaccg

SEQ ID NO: 8335 - DNA, 22 bp, Artificial Sequence
  Description of Artificial Sequence: Synthetic oligonucleotide
cggactcgtcgacgagtccgtg

SEQ ID NO: 8336 - DNA, 22 bp, Artificial Sequence
  Description of Artificial Sequence: Synthetic oligonucleotide
cagactcgtcgacgagtctggg

SEQ ID NO: 8337 - DNA, 22 bp, Artificial Sequence
  Description of Artificial Sequence: Synthetic oligonucleotide
cggactcgtcgacgagtccgag

SEQ ID NO: 8338 - DNA, 22 bp, Artificial Sequence
  Description of Artificial Sequence: Synthetic oligonucleotide
ctgactcgtcgacgagtcaggg

SEQ ID NO: 8339 - DNA, 22 bp, Artificial Sequence
  Description of Artificial Sequence: Synthetic oligonucleotide
acgactcgtcgacgagtcgtgg

SEQ ID NO: 8340 - DNA, 22 bp, Artificial Sequence
  Description of Artificial Sequence: Synthetic oligonucleotide
ccgactcgtcgacgagtcggct

SEQ ID NO: 8341 - DNA, 22 bp, Artificial Sequence
  Description of Artificial Sequence: Synthetic oligonucleotide
ccgactcgtcgacgagtcggca

SEQ ID NO: 8342 - DNA, 22 bp, Artificial Sequence
  Description of Artificial Sequence: Synthetic oligonucleotide
gagactcgtcgacgagtctcgc

SEQ ID NO: 8343 - DNA, 22 bp, Artificial Sequence
  Description of Artificial Sequence: Synthetic oligonucleotide
gtgactcgtcgacgagtcacgc

SEQ ID NO: 8344 - DNA, 22 bp, Artificial Sequence
  Description of Artificial Sequence: Synthetic oligonucleotide
aggactcgtcgacgagtcctgc

SEQ ID NO: 8345 - DNA, 22 bp, Artificial Sequence
  Description of Artificial Sequence: Synthetic oligonucleotide
tggactcgtcgacgagtccagc

SEQ ID NO: 8346 - DNA, 22 bp, Artificial Sequence
  Description of Artificial Sequence: Synthetic oligonucleotide
aggactcgtcgacgagtcctcg

SEQ ID NO: 8347 - DNA, 22 bp, Artificial Sequence
  Description of Artificial Sequence: Synthetic oligonucleotide
tggactcgtcgacgagtccacg

SEQ ID NO: 8348 - DNA, 22 bp, Artificial Sequence
  Description of Artificial Sequence: Synthetic oligonucleotide
ccgactcgtcgacgagtcggtg

SEQ ID NO: 8349 - DNA, 22 bp, Artificial Sequence
  Description of Artificial Sequence: Synthetic oligonucleotide
ccgactcgtcgacgagtcggag

SEQ ID NO: 8350 - DNA, 22 bp, Artificial Sequence
  Description of Artificial Sequence: Synthetic oligonucleotide
gggactcgtcgacgagtcccgc

SEQ ID NO: 8351 - DNA, 22 bp, Artificial Sequence
  Description of Artificial Sequence: Synthetic oligonucleotide
gggactcgtcgacgagtccctc

SEQ ID NO: 8352 - DNA, 22 bp, Artificial Sequence
  Description of Artificial Sequence: Synthetic oligonucleotide
gggactcgtcgacgagtcccac

SEQ ID NO: 8353 - DNA, 22 bp, Artificial Sequence
  Description of Artificial Sequence: Synthetic oligonucleotide
ccgactcctataggagtcggtc

SEQ ID NO: 8354 - DNA, 22 bp, Artificial Sequence
  Description of Artificial Sequence: Synthetic oligonucleotide
acgactcctataggagtcgtgc

SEQ ID NO: 8355 - DNA, 22 bp, Artificial Sequence
  Description of Artificial Sequence: Synthetic oligonucleotide
cagactcctataggagtctggc

SEQ ID NO: 8356 - DNA, 22 bp, Artificial Sequence
  Description of Artificial Sequence: Synthetic oligonucleotide
ccgactcctataggagtcggga

SEQ ID NO: 8357 - DNA, 22 bp, Artificial Sequence
  Description of Artificial Sequence: Synthetic oligonucleotide
ccgactcctataggagtcggac

SEQ ID NO: 8358 - DNA, 22 bp, Artificial Sequence
  Description of Artificial Sequence: Synthetic oligonucleotide
ctgactcctataggagtcaggc

SEQ ID NO: 8359 - DNA, 22 bp, Artificial Sequence
  Description of Artificial Sequence: Synthetic oligonucleotide
gcgactcctataggagtcgccc

SEQ ID NO: 8360 - DNA, 22 bp, Artificial Sequence
  Description of Artificial Sequence: Synthetic oligonucleotide
gcgactcctataggagtcgcct

SEQ ID NO: 8361 - DNA, 22 bp, Artificial Sequence
  Description of Artificial Sequence: Synthetic oligonucleotide
gcgactcctataggagtcgctc

SEQ ID NO: 8362 - DNA, 22 bp, Artificial Sequence
  Description of Artificial Sequence: Synthetic oligonucleotide
acgactcctataggagtcgtcc

SEQ ID NO: 8363 - DNA, 22 bp, Artificial Sequence
  Description of Artificial Sequence: Synthetic oligonucleotide
gagactcctataggagtctccc

SEQ ID NO: 8364 - DNA, 22 bp, Artificial Sequence
  Description of Artificial Sequence: Synthetic oligonucleotide
gcgactcctataggagtcgcca

SEQ ID NO: 8365 - DNA, 22 bp, Artificial Sequence
  Description of Artificial Sequence: Synthetic oligonucleotide
gcgactcctataggagtcgcac

SEQ ID NO: 8366 - DNA, 22 bp, Artificial Sequence
  Description of Artificial Sequence: Synthetic oligonucleotide
gtgactcctataggagtcaccc

SEQ ID NO: 8367 - DNA, 22 bp, Artificial Sequence
  Description of Artificial Sequence: Synthetic oligonucleotide
gggactcctataggagtcccgt

SEQ ID NO: 8368 - DNA, 22 bp, Artificial Sequence
  Description of Artificial Sequence: Synthetic oligonucleotide
gggactcctataggagtccctg

SEQ ID NO: 8369 - DNA, 22 bp, Artificial Sequence
  Description of Artificial Sequence: Synthetic oligonucleotide
aggactcctataggagtcctgg

SEQ ID NO: 8370 - DNA, 22 bp, Artificial Sequence
  Description of Artificial Sequence: Synthetic oligonucleotide
gagactcctataggagtctcgg

SEQ ID NO: 8371 - DNA, 22 bp, Artificial Sequence
  Description of Artificial Sequence: Synthetic oligonucleotide
gggactcctataggagtcccga

SEQ ID NO: 8372 - DNA, 22 bp, Artificial Sequence
  Description of Artificial Sequence: Synthetic oligonucleotide
gggactcctataggagtcccag

SEQ ID NO: 8373 - DNA, 22 bp, Artificial Sequence
  Description of Artificial Sequence: Synthetic oligonucleotide
tggactcctataggagtccagg

SEQ ID NO: 8374 - DNA, 22 bp, Artificial Sequence
  Description of Artificial Sequence: Synthetic oligonucleotide
gtgactcctataggagtcacgg

SEQ ID NO: 8375 - DNA, 22 bp, Artificial Sequence
  Description of Artificial Sequence: Synthetic oligonucleotide
gcgactcctataggagtcgccg

SEQ ID NO: 8376 - DNA, 22 bp, Artificial Sequence
  Description of Artificial Sequence: Synthetic oligonucleotide
gcgactcctataggagtcgctg

SEQ ID NO: 8377 - DNA, 22 bp, Artificial Sequence
  Description of Artificial Sequence: Synthetic oligonucleotide
acgactcctataggagtcgtcg

SEQ ID NO: 8378 - DNA, 22 bp, Artificial Sequence
  Description of Artificial Sequence: Synthetic oligonucleotide
gagactcctataggagtctccg

SEQ ID NO: 8379 - DNA, 22 bp, Artificial Sequence
  Description of Artificial Sequence: Synthetic oligonucleotide
gcgactcctataggagtcgcag

SEQ ID NO: 8380 - DNA, 22 bp, Artificial Sequence
  Description of Artificial Sequence: Synthetic oligonucleotide
gtgactcctataggagtcaccg

SEQ ID NO: 8381 - DNA, 22 bp, Artificial Sequence
  Description of Artificial Sequence: Synthetic oligonucleotide
cggactcctataggagtccgtg

SEQ ID NO: 8382 - DNA, 22 bp, Artificial Sequence
  Description of Artificial Sequence: Synthetic oligonucleotide
cagactcctataggagtctggg

SEQ ID NO: 8383 - DNA, 22 bp, Artificial Sequence
  Description of Artificial Sequence: Synthetic oligonucleotide
cggactcctataggagtccgag

SEQ ID NO: 8384 - DNA, 22 bp, Artificial Sequence
  Description of Artificial Sequence: Synthetic oligonucleotide
ctgactcctataggagtcaggg

SEQ ID NO: 8385 - DNA, 22 bp, Artificial Sequence
  Description of Artificial Sequence: Synthetic oligonucleotide
acgactcctataggagtcgtgg

SEQ ID NO: 8386 - DNA, 22 bp, Artificial Sequence
  Description of Artificial Sequence: Synthetic oligonucleotide
ccgactcctataggagtcggct

SEQ ID NO: 8387 - DNA, 22 bp, Artificial Sequence
  Description of Artificial Sequence: Synthetic oligonucleotide
ccgactcctataggagtcggca

SEQ ID NO: 8388 - DNA, 22 bp, Artificial Sequence
  Description of Artificial Sequence: Synthetic oligonucleotide
gagactcctataggagtctcgc

SEQ ID NO: 8389 - DNA, 22 bp, Artificial Sequence
  Description of Artificial Sequence: Synthetic oligonucleotide
gtgactcctataggagtcacgc

SEQ ID NO: 8390 - DNA, 22 bp, Artificial Sequence
  Description of Artificial Sequence: Synthetic oligonucleotide
aggactcctataggagtcctgc

SEQ ID NO: 8391 - DNA, 22 bp, Artificial Sequence
  Description of Artificial Sequence: Synthetic oligonucleotide
tggactcctataggagtccagc

SEQ ID NO: 8392 - DNA, 22 bp, Artificial Sequence
  Description of Artificial Sequence: Synthetic oligonucleotide
aggactcctataggagtcctcg

SEQ ID NO: 8393 - DNA, 22 bp, Artificial Sequence
  Description of Artificial Sequence: Synthetic oligonucleotide
tggactcctataggagtccacg

SEQ ID NO: 8394 - DNA, 22 bp, Artificial Sequence
  Description of Artificial Sequence: Synthetic oligonucleotide
ccgactcctataggagtcggtg

SEQ ID NO: 8395 - DNA, 22 bp, Artificial Sequence
  Description of Artificial Sequence: Synthetic oligonucleotide
ccgactcctataggagtcggag

SEQ ID NO: 8396 - DNA, 22 bp, Artificial Sequence
  Description of Artificial Sequence: Synthetic oligonucleotide
gggactcctataggagtcccgc

SEQ ID NO: 8397 - DNA, 22 bp, Artificial Sequence
  Description of Artificial Sequence: Synthetic oligonucleotide
gggactcctataggagtccctc

SEQ ID NO: 8398 - DNA, 22 bp, Artificial Sequence
  Description of Artificial Sequence: Synthetic oligonucleotide
gggactcctataggagtcccac

SEQ ID NO: 8399 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccttaaggagtcnnnn

SEQ ID NO: 8400 - DNA, 22 bp, Artificial Sequence
  Description of Artificial Sequence: Synthetic oligonucleotide
cggactccttaaggagtccgcc

SEQ ID NO: 8401 - DNA, 22 bp, Artificial Sequence
  Description of Artificial Sequence: Synthetic oligonucleotide
cggactccttaaggagtccgct

SEQ ID NO: 8402 - DNA, 22 bp, Artificial Sequence
  Description of Artificial Sequence: Synthetic oligonucleotide
cggactccttaaggagtccgtc

SEQ ID NO: 8403 - DNA, 22 bp, Artificial Sequence
  Description of Artificial Sequence: Synthetic oligonucleotide
aggactccttaaggagtcctcc

SEQ ID NO: 8404 - DNA, 22 bp, Artificial Sequence
  Description of Artificial Sequence: Synthetic oligonucleotide
cagactccttaaggagtctgcc

SEQ ID NO: 8405 - DNA, 22 bp, Artificial Sequence
  Description of Artificial Sequence: Synthetic oligonucleotide
cggactccttaaggagtccgca

SEQ ID NO: 8406 - DNA, 22 bp, Artificial Sequence
  Description of Artificial Sequence: Synthetic oligonucleotide
cggactccttaaggagtccgac

SEQ ID NO: 8407 - DNA, 22 bp, Artificial Sequence
  Description of Artificial Sequence: Synthetic oligonucleotide
tggactccttaaggagtccacc

SEQ ID NO: 8408 - DNA, 22 bp, Artificial Sequence
  Description of Artificial Sequence: Synthetic oligonucleotide
ctgactccttaaggagtcagcc

SEQ ID NO: 8409 - DNA, 22 bp, Artificial Sequence
  Description of Artificial Sequence: Synthetic oligonucleotide
ccgactccttaaggagtcgggc

SEQ ID NO: 8410 - DNA, 22 bp, Artificial Sequence
  Description of Artificial Sequence: Synthetic oligonucleotide
ccgactccttaaggagtcgggt

SEQ ID NO: 8411 - DNA, 22 bp, Artificial Sequence
  Description of Artificial Sequence: Synthetic oligonucleotide
ccgactccttaaggagtcggtc

SEQ ID NO: 8412 - DNA, 22 bp, Artificial Sequence
  Description of Artificial Sequence: Synthetic oligonucleotide
acgactccttaaggagtcgtgc

SEQ ID NO: 8413 - DNA, 22 bp, Artificial Sequence
  Description of Artificial Sequence: Synthetic oligonucleotide
cagactccttaaggagtctggc

SEQ ID NO: 8414 - DNA, 22 bp, Artificial Sequence
  Description of Artificial Sequence: Synthetic oligonucleotide
ccgactccttaaggagtcggga

SEQ ID NO: 8415 - DNA, 22 bp, Artificial Sequence
  Description of Artificial Sequence: Synthetic oligonucleotide
ccgactccttaaggagtcggac

SEQ ID NO: 8416 - DNA, 22 bp, Artificial Sequence
  Description of Artificial Sequence: Synthetic oligonucleotide
ctgactccttaaggagtcaggc

SEQ ID NO: 8417 - DNA, 22 bp, Artificial Sequence
  Description of Artificial Sequence: Synthetic oligonucleotide
gcgactccttaaggagtcgccc

SEQ ID NO: 8418 - DNA, 22 bp, Artificial Sequence
  Description of Artificial Sequence: Synthetic oligonucleotide
gcgactccttaaggagtcgcct

SEQ ID NO: 8419 - DNA, 22 bp, Artificial Sequence
  Description of Artificial Sequence: Synthetic oligonucleotide
gcgactccttaaggagtcgctc

SEQ ID NO: 8420 - DNA, 22 bp, Artificial Sequence
  Description of Artificial Sequence: Synthetic oligonucleotide
acgactccttaaggagtcgtcc

SEQ ID NO: 8421 - DNA, 22 bp, Artificial Sequence
  Description of Artificial Sequence: Synthetic oligonucleotide
gagactccttaaggagtctccc

SEQ ID NO: 8422 - DNA, 22 bp, Artificial Sequence
  Description of Artificial Sequence: Synthetic oligonucleotide
gcgactccttaaggagtcgcca

SEQ ID NO: 8423 - DNA, 22 bp, Artificial Sequence
  Description of Artificial Sequence: Synthetic oligonucleotide
gcgactccttaaggagtcgcac

SEQ ID NO: 8424 - DNA, 22 bp, Artificial Sequence
  Description of Artificial Sequence: Synthetic oligonucleotide
gtgactccttaaggagtcaccc

SEQ ID NO: 8425 - DNA, 22 bp, Artificial Sequence
  Description of Artificial Sequence: Synthetic oligonucleotide
gggactccttaaggagtcccgt

SEQ ID NO: 8426 - DNA, 22 bp, Artificial Sequence
  Description of Artificial Sequence: Synthetic oligonucleotide
gggactccttaaggagtccctg

SEQ ID NO: 8427 - DNA, 22 bp, Artificial Sequence
  Description of Artificial Sequence: Synthetic oligonucleotide
aggactccttaaggagtcctgg

SEQ ID NO: 8428 - DNA, 22 bp, Artificial Sequence
  Description of Artificial Sequence: Synthetic oligonucleotide
gagactccttaaggagtctcgg

SEQ ID NO: 8429 - DNA, 22 bp, Artificial Sequence
  Description of Artificial Sequence: Synthetic oligonucleotide
gggactccttaaggagtcccga

SEQ ID NO: 8430 - DNA, 22 bp, Artificial Sequence
  Description of Artificial Sequence: Synthetic oligonucleotide
gggactccttaaggagtcccag

SEQ ID NO: 8431 - DNA, 22 bp, Artificial Sequence
  Description of Artificial Sequence: Synthetic oligonucleotide
tggactccttaaggagtccagg

SEQ ID NO: 8432 - DNA, 22 bp, Artificial Sequence
  Description of Artificial Sequence: Synthetic oligonucleotide
gtgactccttaaggagtcacgg

SEQ ID NO: 8433 - DNA, 22 bp, Artificial Sequence
  Description of Artificial Sequence: Synthetic oligonucleotide
gcgactccttaaggagtcgccg

SEQ ID NO: 8434 - DNA, 22 bp, Artificial Sequence
  Description of Artificial Sequence: Synthetic oligonucleotide
gcgactccttaaggagtcgctg

SEQ ID NO: 8435 - DNA, 22 bp, Artificial Sequence
  Description of Artificial Sequence: Synthetic oligonucleotide
acgactccttaaggagtcgtcg

SEQ ID NO: 8436 - DNA, 22 bp, Artificial Sequence
  Description of Artificial Sequence: Synthetic oligonucleotide
gagactccttaaggagtctccg

SEQ ID NO: 8437 - DNA, 22 bp, Artificial Sequence
  Description of Artificial Sequence: Synthetic oligonucleotide
gcgactccttaaggagtcgcag

SEQ ID NO: 8438 - DNA, 22 bp, Artificial Sequence
  Description of Artificial Sequence: Synthetic oligonucleotide
gtgactccttaaggagtcaccg

SEQ ID NO: 8439 - DNA, 22 bp, Artificial Sequence
  Description of Artificial Sequence: Synthetic oligonucleotide
cggactccttaaggagtccgtg

SEQ ID NO: 8440 - DNA, 22 bp, Artificial Sequence
  Description of Artificial Sequence: Synthetic oligonucleotide
cagactccttaaggagtctggg

SEQ ID NO: 8441 - DNA, 22 bp, Artificial Sequence
  Description of Artificial Sequence: Synthetic oligonucleotide
cggactccttaaggagtccgag

SEQ ID NO: 8442 - DNA, 22 bp, Artificial Sequence
  Description of Artificial Sequence: Synthetic oligonucleotide
ctgactccttaaggagtcaggg

SEQ ID NO: 8443 - DNA, 22 bp, Artificial Sequence
  Description of Artificial Sequence: Synthetic oligonucleotide
acgactccttaaggagtcgtgg

SEQ ID NO: 8444 - DNA, 22 bp, Artificial Sequence
  Description of Artificial Sequence: Synthetic oligonucleotide
ccgactccttaaggagtcggct

SEQ ID NO: 8445 - DNA, 22 bp, Artificial Sequence
  Description of Artificial Sequence: Synthetic oligonucleotide
ccgactccttaaggagtcggca

SEQ ID NO: 8446 - DNA, 22 bp, Artificial Sequence
  Description of Artificial Sequence: Synthetic oligonucleotide
gagactccttaaggagtctcgc

SEQ ID NO: 8447 - DNA, 22 bp, Artificial Sequence
  Description of Artificial Sequence: Synthetic oligonucleotide
gtgactccttaaggagtcacgc

SEQ ID NO: 8448 - DNA, 22 bp, Artificial Sequence
  Description of Artificial Sequence: Synthetic oligonucleotide
aggactccttaaggagtcctgc

SEQ ID NO: 8449 - DNA, 22 bp, Artificial Sequence
  Description of Artificial Sequence: Synthetic oligonucleotide
tggactccttaaggagtccagc

SEQ ID NO: 8450 - DNA, 22 bp, Artificial Sequence
  Description of Artificial Sequence: Synthetic oligonucleotide
aggactccttaaggagtcctcg

SEQ ID NO: 8451 - DNA, 22 bp, Artificial Sequence
  Description of Artificial Sequence: Synthetic oligonucleotide
tggactccttaaggagtccacg

SEQ ID NO: 8452 - DNA, 22 bp, Artificial Sequence
  Description of Artificial Sequence: Synthetic oligonucleotide
ccgactccttaaggagtcggtg

SEQ ID NO: 8453 - DNA, 22 bp, Artificial Sequence
  Description of Artificial Sequence: Synthetic oligonucleotide
ccgactccttaaggagtcggag

SEQ ID NO: 8454 - DNA, 22 bp, Artificial Sequence
  Description of Artificial Sequence: Synthetic oligonucleotide
gggactccttaaggagtcccgc

SEQ ID NO: 8455 - DNA, 22 bp, Artificial Sequence
  Description of Artificial Sequence: Synthetic oligonucleotide
gggactccttaaggagtccctc

SEQ ID NO: 8456 - DNA, 22 bp, Artificial Sequence
  Description of Artificial Sequence: Synthetic oligonucleotide
gggactccttaaggagtcccac

SEQ ID NO: 8457 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcctgcaggagtcnnnn

SEQ ID NO: 8458 - DNA, 22 bp, Artificial Sequence
  Description of Artificial Sequence: Synthetic oligonucleotide
cggactcctgcaggagtccgcc

SEQ ID NO: 8459 - DNA, 22 bp, Artificial Sequence
  Description of Artificial Sequence: Synthetic oligonucleotide
cggactcctgcaggagtccgct

SEQ ID NO: 8460 - DNA, 22 bp, Artificial Sequence
  Description of Artificial Sequence: Synthetic oligonucleotide
cggactcctgcaggagtccgtc

SEQ ID NO: 8461 - DNA, 22 bp, Artificial Sequence
  Description of Artificial Sequence: Synthetic oligonucleotide
aggactcctgcaggagtcctcc

SEQ ID NO: 8462 - DNA, 22 bp, Artificial Sequence
  Description of Artificial Sequence: Synthetic oligonucleotide
cagactcctgcaggagtctgcc

SEQ ID NO: 8463 - DNA, 22 bp, Artificial Sequence
  Description of Artificial Sequence: Synthetic oligonucleotide
cggactcctgcaggagtccgca

SEQ ID NO: 8464 - DNA, 22 bp, Artificial Sequence
  Description of Artificial Sequence: Synthetic oligonucleotide
cggactcctgcaggagtccgac

SEQ ID NO: 8465 - DNA, 22 bp, Artificial Sequence
  Description of Artificial Sequence: Synthetic oligonucleotide
tggactcctgcaggagtccacc

SEQ ID NO: 8466 - DNA, 22 bp, Artificial Sequence
  Description of Artificial Sequence: Synthetic oligonucleotide
ctgactcctgcaggagtcagcc

SEQ ID NO: 8467 - DNA, 22 bp, Artificial Sequence
  Description of Artificial Sequence: Synthetic oligonucleotide
ccgactcctgcaggagtcgggc

SEQ ID NO: 8468 - DNA, 22 bp, Artificial Sequence
  Description of Artificial Sequence: Synthetic oligonucleotide
ccgactcctgcaggagtcgggt

SEQ ID NO: 8469 - DNA, 22 bp, Artificial Sequence
  Description of Artificial Sequence: Synthetic oligonucleotide
ccgactcctgcaggagtcggtc

SEQ ID NO: 8470 - DNA, 22 bp, Artificial Sequence
  Description of Artificial Sequence: Synthetic oligonucleotide
acgactcctgcaggagtcgtgc

SEQ ID NO: 8471 - DNA, 22 bp, Artificial Sequence
  Description of Artificial Sequence: Synthetic oligonucleotide
cagactcctgcaggagtctggc

SEQ ID NO: 8472 - DNA, 22 bp, Artificial Sequence
  Description of Artificial Sequence: Synthetic oligonucleotide
ccgactcctgcaggagtcggga

SEQ ID NO: 8473 - DNA, 22 bp, Artificial Sequence
  Description of Artificial Sequence: Synthetic oligonucleotide
ccgactcctgcaggagtcggac

SEQ ID NO: 8474 - DNA, 22 bp, Artificial Sequence
  Description of Artificial Sequence: Synthetic oligonucleotide
ctgactcctgcaggagtcaggc

SEQ ID NO: 8475 - DNA, 22 bp, Artificial Sequence
  Description of Artificial Sequence: Synthetic oligonucleotide
gcgactcctgcaggagtcgccc

SEQ ID NO: 8476 - DNA, 22 bp, Artificial Sequence
  Description of Artificial Sequence: Synthetic oligonucleotide
gcgactcctgcaggagtcgcct

SEQ ID NO: 8477 - DNA, 22 bp, Artificial Sequence
  Description of Artificial Sequence: Synthetic oligonucleotide
gcgactcctgcaggagtcgctc

SEQ ID NO: 8478 - DNA, 22 bp, Artificial Sequence
  Description of Artificial Sequence: Synthetic oligonucleotide
acgactcctgcaggagtcgtcc

SEQ ID NO: 8479 - DNA, 22 bp, Artificial Sequence
  Description of Artificial Sequence: Synthetic oligonucleotide
gagactcctgcaggagtctccc

SEQ ID NO: 8480 - DNA, 22 bp, Artificial Sequence
  Description of Artificial Sequence: Synthetic oligonucleotide
gcgactcctgcaggagtcgcca

SEQ ID NO: 8481 - DNA, 22 bp, Artificial Sequence
  Description of Artificial Sequence: Synthetic oligonucleotide
gcgactcctgcaggagtcgcac

SEQ ID NO: 8482 - DNA, 22 bp, Artificial Sequence
  Description of Artificial Sequence: Synthetic oligonucleotide
gtgactcctgcaggagtcaccc

SEQ ID NO: 8483 - DNA, 22 bp, Artificial Sequence
  Description of Artificial Sequence: Synthetic oligonucleotide
gggactcctgcaggagtcccgt

SEQ ID NO: 8484 - DNA, 22 bp, Artificial Sequence
  Description of Artificial Sequence: Synthetic oligonucleotide
gggactcctgcaggagtccctg

SEQ ID NO: 8485 - DNA, 22 bp, Artificial Sequence
  Description of Artificial Sequence: Synthetic oligonucleotide
aggactcctgcaggagtcctgg

SEQ ID NO: 8486 - DNA, 22 bp, Artificial Sequence
  Description of Artificial Sequence: Synthetic oligonucleotide
gagactcctgcaggagtctcgg

SEQ ID NO: 8487 - DNA, 22 bp, Artificial Sequence
  Description of Artificial Sequence: Synthetic oligonucleotide
gggactcctgcaggagtcccga

SEQ ID NO: 8488 - DNA, 22 bp, Artificial Sequence
  Description of Artificial Sequence: Synthetic oligonucleotide
gggactcctgcaggagtcccag

SEQ ID NO: 8489 - DNA, 22 bp, Artificial Sequence
  Description of Artificial Sequence: Synthetic oligonucleotide
tggactcctgcaggagtccagg

SEQ ID NO: 8490 - DNA, 22 bp, Artificial Sequence
  Description of Artificial Sequence: Synthetic oligonucleotide
gtgactcctgcaggagtcacgg

SEQ ID NO: 8491 - DNA, 22 bp, Artificial Sequence
  Description of Artificial Sequence: Synthetic oligonucleotide
gcgactcctgcaggagtcgccg

SEQ ID NO: 8492 - DNA, 22 bp, Artificial Sequence
  Description of Artificial Sequence: Synthetic oligonucleotide
gcgactcctgcaggagtcgctg

SEQ ID NO: 8493 - DNA, 22 bp, Artificial Sequence
  Description of Artificial Sequence: Synthetic oligonucleotide
acgactcctgcaggagtcgtcg

SEQ ID NO: 8494 - DNA, 22 bp, Artificial Sequence
  Description of Artificial Sequence: Synthetic oligonucleotide
gagactcctgcaggagtctccg

SEQ ID NO: 8495 - DNA, 22 bp, Artificial Sequence
  Description of Artificial Sequence: Synthetic oligonucleotide
gcgactcctgcaggagtcgcag

SEQ ID NO: 8496 - DNA, 22 bp, Artificial Sequence
  Description of Artificial Sequence: Synthetic oligonucleotide
gtgactcctgcaggagtcaccg

SEQ ID NO: 8497 - DNA, 22 bp, Artificial Sequence
  Description of Artificial Sequence: Synthetic oligonucleotide
cggactcctgcaggagtccgtg

SEQ ID NO: 8498 - DNA, 22 bp, Artificial Sequence
  Description of Artificial Sequence: Synthetic oligonucleotide
cagactcctgcaggagtctggg

SEQ ID NO: 8499 - DNA, 22 bp, Artificial Sequence
  Description of Artificial Sequence: Synthetic oligonucleotide
cggactcctgcaggagtccgag

SEQ ID NO: 8500 - DNA, 22 bp, Artificial Sequence
  Description of Artificial Sequence: Synthetic oligonucleotide
ctgactcctgcaggagtcaggg

SEQ ID NO: 8501 - DNA, 22 bp, Artificial Sequence
  Description of Artificial Sequence: Synthetic oligonucleotide
acgactcctgcaggagtcgtgg

SEQ ID NO: 8502 - DNA, 22 bp, Artificial Sequence
  Description of Artificial Sequence: Synthetic oligonucleotide
ccgactcctgcaggagtcggct

SEQ ID NO: 8503 - DNA, 22 bp, Artificial Sequence
  Description of Artificial Sequence: Synthetic oligonucleotide
ccgactcctgcaggagtcggca

SEQ ID NO: 8504 - DNA, 22 bp, Artificial Sequence
  Description of Artificial Sequence: Synthetic oligonucleotide
gagactcctgcaggagtctcgc

SEQ ID NO: 8505 - DNA, 22 bp, Artificial Sequence
  Description of Artificial Sequence: Synthetic oligonucleotide
gtgactcctgcaggagtcacgc

SEQ ID NO: 8506 - DNA, 22 bp, Artificial Sequence
  Description of Artificial Sequence: Synthetic oligonucleotide
aggactcctgcaggagtcctgc

SEQ ID NO: 8507 - DNA, 22 bp, Artificial Sequence
  Description of Artificial Sequence: Synthetic oligonucleotide
tggactcctgcaggagtccagc

SEQ ID NO: 8508 - DNA, 22 bp, Artificial Sequence
  Description of Artificial Sequence: Synthetic oligonucleotide
aggactcctgcaggagtcctcg

SEQ ID NO: 8509 - DNA, 22 bp, Artificial Sequence
  Description of Artificial Sequence: Synthetic oligonucleotide
tggactcctgcaggagtccacg

SEQ ID NO: 8510 - DNA, 22 bp, Artificial Sequence
  Description of Artificial Sequence: Synthetic oligonucleotide
ccgactcctgcaggagtcggtg

SEQ ID NO: 8511 - DNA, 22 bp, Artificial Sequence
  Description of Artificial Sequence: Synthetic oligonucleotide
ccgactcctgcaggagtcggag

SEQ ID NO: 8512 - DNA, 22 bp, Artificial Sequence
  Description of Artificial Sequence: Synthetic oligonucleotide
gggactcctgcaggagtcccgc

SEQ ID NO: 8513 - DNA, 22 bp, Artificial Sequence
  Description of Artificial Sequence: Synthetic oligonucleotide
gggactcctgcaggagtccctc

SEQ ID NO: 8514 - DNA, 22 bp, Artificial Sequence
  Description of Artificial Sequence: Synthetic oligonucleotide
gggactcctgcaggagtcccac

SEQ ID NO: 8515 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcctcgaggagtcnnnn

SEQ ID NO: 8516 - DNA, 22 bp, Artificial Sequence
  Description of Artificial Sequence: Synthetic oligonucleotide
cggactcctcgaggagtccgcc

SEQ ID NO: 8517 - DNA, 22 bp, Artificial Sequence
  Description of Artificial Sequence: Synthetic oligonucleotide
cggactcctcgaggagtccgct

SEQ ID NO: 8518 - DNA, 22 bp, Artificial Sequence
  Description of Artificial Sequence: Synthetic oligonucleotide
cggactcctcgaggagtccgtc

SEQ ID NO: 8519 - DNA, 22 bp, Artificial Sequence
  Description of Artificial Sequence: Synthetic oligonucleotide
aggactcctcgaggagtcctcc

SEQ ID NO: 8520 - DNA, 22 bp, Artificial Sequence
  Description of Artificial Sequence: Synthetic oligonucleotide
cagactcctcgaggagtctgcc

SEQ ID NO: 8521 - DNA, 22 bp, Artificial Sequence
  Description of Artificial Sequence: Synthetic oligonucleotide
cggactcctcgaggagtccgca

SEQ ID NO: 8522 - DNA, 22 bp, Artificial Sequence
  Description of Artificial Sequence: Synthetic oligonucleotide
cggactcctcgaggagtccgac

SEQ ID NO: 8523 - DNA, 22 bp, Artificial Sequence
  Description of Artificial Sequence: Synthetic oligonucleotide
tggactcctcgaggagtccacc

SEQ ID NO: 8524 - DNA, 22 bp, Artificial Sequence
  Description of Artificial Sequence: Synthetic oligonucleotide
ctgactcctcgaggagtcagcc

SEQ ID NO: 8525 - DNA, 22 bp, Artificial Sequence
  Description of Artificial Sequence: Synthetic oligonucleotide
ccgactcctcgaggagtcgggc

SEQ ID NO: 8526 - DNA, 22 bp, Artificial Sequence
  Description of Artificial Sequence: Synthetic oligonucleotide
ccgactcctcgaggagtcgggt

SEQ ID NO: 8527 - DNA, 22 bp, Artificial Sequence
  Description of Artificial Sequence: Synthetic oligonucleotide
ccgactcctcgaggagtcggtc

SEQ ID NO: 8528 - DNA, 22 bp, Artificial Sequence
  Description of Artificial Sequence: Synthetic oligonucleotide
acgactcctcgaggagtcgtgc

SEQ ID NO: 8529 - DNA, 22 bp, Artificial Sequence
  Description of Artificial Sequence: Synthetic oligonucleotide
cagactcctcgaggagtctggc

SEQ ID NO: 8530 - DNA, 22 bp, Artificial Sequence
  Description of Artificial Sequence: Synthetic oligonucleotide
ccgactcctcgaggagtcggga

SEQ ID NO: 8531 - DNA, 22 bp, Artificial Sequence
  Description of Artificial Sequence: Synthetic oligonucleotide
ccgactcctcgaggagtcggac

SEQ ID NO: 8532 - DNA, 22 bp, Artificial Sequence
  Description of Artificial Sequence: Synthetic oligonucleotide
ctgactcctcgaggagtcaggc

SEQ ID NO: 8533 - DNA, 22 bp, Artificial Sequence
  Description of Artificial Sequence: Synthetic oligonucleotide
gcgactcctcgaggagtcgccc

SEQ ID NO: 8534 - DNA, 22 bp, Artificial Sequence
  Description of Artificial Sequence: Synthetic oligonucleotide
gcgactcctcgaggagtcgcct

SEQ ID NO: 8535 - DNA, 22 bp, Artificial Sequence
  Description of Artificial Sequence: Synthetic oligonucleotide
gcgactcctcgaggagtcgctc

SEQ ID NO: 8536 - DNA, 22 bp, Artificial Sequence
  Description of Artificial Sequence: Synthetic oligonucleotide
acgactcctcgaggagtcgtcc

SEQ ID NO: 8537 - DNA, 22 bp, Artificial Sequence
  Description of Artificial Sequence: Synthetic oligonucleotide
gagactcctcgaggagtctccc

SEQ ID NO: 8538 - DNA, 22 bp, Artificial Sequence
  Description of Artificial Sequence: Synthetic oligonucleotide
gcgactcctcgaggagtcgcca

SEQ ID NO: 8539 - DNA, 22 bp, Artificial Sequence
  Description of Artificial Sequence: Synthetic oligonucleotide
gcgactcctcgaggagtcgcac

SEQ ID NO: 8540 - DNA, 22 bp, Artificial Sequence
  Description of Artificial Sequence: Synthetic oligonucleotide
gtgactcctcgaggagtcaccc

SEQ ID NO: 8541 - DNA, 22 bp, Artificial Sequence
  Description of Artificial Sequence: Synthetic oligonucleotide
gggactcctcgaggagtcccgt

SEQ ID NO: 8542 - DNA, 22 bp, Artificial Sequence
  Description of Artificial Sequence: Synthetic oligonucleotide
gggactcctcgaggagtccctg

SEQ ID NO: 8543 - DNA, 22 bp, Artificial Sequence
  Description of Artificial Sequence: Synthetic oligonucleotide
aggactcctcgaggagtcctgg

SEQ ID NO: 8544 - DNA, 22 bp, Artificial Sequence
  Description of Artificial Sequence: Synthetic oligonucleotide
gagactcctcgaggagtctcgg

SEQ ID NO: 8545 - DNA, 22 bp, Artificial Sequence
  Description of Artificial Sequence: Synthetic oligonucleotide
gggactcctcgaggagtcccga

SEQ ID NO: 8546 - DNA, 22 bp, Artificial Sequence
  Description of Artificial Sequence: Synthetic oligonucleotide
gggactcctcgaggagtcccag

SEQ ID NO: 8547 - DNA, 22 bp, Artificial Sequence
  Description of Artificial Sequence: Synthetic oligonucleotide
tggactcctcgaggagtccagg

SEQ ID NO: 8548 - DNA, 22 bp, Artificial Sequence
  Description of Artificial Sequence: Synthetic oligonucleotide
gtgactcctcgaggagtcacgg

SEQ ID NO: 8549 - DNA, 22 bp, Artificial Sequence
  Description of Artificial Sequence: Synthetic oligonucleotide
gcgactcctcgaggagtcgccg

SEQ ID NO: 8550 - DNA, 22 bp, Artificial Sequence
  Description of Artificial Sequence: Synthetic oligonucleotide
gcgactcctcgaggagtcgctg

SEQ ID NO: 8551 - DNA, 22 bp, Artificial Sequence
  Description of Artificial Sequence: Synthetic oligonucleotide
acgactcctcgaggagtcgtcg

SEQ ID NO: 8552 - DNA, 22 bp, Artificial Sequence
  Description of Artificial Sequence: Synthetic oligonucleotide
gagactcctcgaggagtctccg

SEQ ID NO: 8553 - DNA, 22 bp, Artificial Sequence
  Description of Artificial Sequence: Synthetic oligonucleotide
gcgactcctcgaggagtcgcag

SEQ ID NO: 8554 - DNA, 22 bp, Artificial Sequence
  Description of Artificial Sequence: Synthetic oligonucleotide
gtgactcctcgaggagtcaccg

SEQ ID NO: 8555 - DNA, 22 bp, Artificial Sequence
  Description of Artificial Sequence: Synthetic oligonucleotide
cggactcctcgaggagtccgtg

SEQ ID NO: 8556 - DNA, 22 bp, Artificial Sequence
  Description of Artificial Sequence: Synthetic oligonucleotide
cagactcctcgaggagtctggg

SEQ ID NO: 8557 - DNA, 22 bp, Artificial Sequence
  Description of Artificial Sequence: Synthetic oligonucleotide
cggactcctcgaggagtccgag

SEQ ID NO: 8558 - DNA, 22 bp, Artificial Sequence
  Description of Artificial Sequence: Synthetic oligonucleotide
ctgactcctcgaggagtcaggg

SEQ ID NO: 8559 - DNA, 22 bp, Artificial Sequence
  Description of Artificial Sequence: Synthetic oligonucleotide
acgactcctcgaggagtcgtgg

SEQ ID NO: 8560 - DNA, 22 bp, Artificial Sequence
  Description of Artificial Sequence: Synthetic oligonucleotide
ccgactcctcgaggagtcggct

SEQ ID NO: 8561 - DNA, 22 bp, Artificial Sequence
  Description of Artificial Sequence: Synthetic oligonucleotide
ccgactcctcgaggagtcggca

SEQ ID NO: 8562 - DNA, 22 bp, Artificial Sequence
  Description of Artificial Sequence: Synthetic oligonucleotide
gagactcctcgaggagtctcgc

SEQ ID NO: 8563 - DNA, 22 bp, Artificial Sequence
  Description of Artificial Sequence: Synthetic oligonucleotide
gtgactcctcgaggagtcacgc

SEQ ID NO: 8564 - DNA, 22 bp, Artificial Sequence
  Description of Artificial Sequence: Synthetic oligonucleotide
aggactcctcgaggagtcctgc

SEQ ID NO: 8565 - DNA, 22 bp, Artificial Sequence
  Description of Artificial Sequence: Synthetic oligonucleotide
tggactcctcgaggagtccagc

SEQ ID NO: 8566 - DNA, 22 bp, Artificial Sequence
  Description of Artificial Sequence: Synthetic oligonucleotide
aggactcctcgaggagtcctcg

SEQ ID NO: 8567 - DNA, 22 bp, Artificial Sequence
  Description of Artificial Sequence: Synthetic oligonucleotide
tggactcctcgaggagtccacg

SEQ ID NO: 8568 - DNA, 22 bp, Artificial Sequence
  Description of Artificial Sequence: Synthetic oligonucleotide
ccgactcctcgaggagtcggtg

SEQ ID NO: 8569 - DNA, 22 bp, Artificial Sequence
  Description of Artificial Sequence: Synthetic oligonucleotide
ccgactcctcgaggagtcggag

SEQ ID NO: 8570 - DNA, 22 bp, Artificial Sequence
  Description of Artificial Sequence: Synthetic oligonucleotide
gggactcctcgaggagtcccgc

SEQ ID NO: 8571 - DNA, 22 bp, Artificial Sequence
  Description of Artificial Sequence: Synthetic oligonucleotide
gggactcctcgaggagtccctc

SEQ ID NO: 8572 - DNA, 22 bp, Artificial Sequence
  Description of Artificial Sequence: Synthetic oligonucleotide
gggactcctcgaggagtcccac

SEQ ID NO: 8573 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccaattggagtcnnnn

SEQ ID NO: 8574 - DNA, 22 bp, Artificial Sequence
  Description of Artificial Sequence: Synthetic oligonucleotide
cggactccaattggagtccgcc

SEQ ID NO: 8575 - DNA, 22 bp, Artificial Sequence
  Description of Artificial Sequence: Synthetic oligonucleotide
cggactccaattggagtccgct

SEQ ID NO: 8576 - DNA, 22 bp, Artificial Sequence
  Description of Artificial Sequence: Synthetic oligonucleotide
cggactccaattggagtccgtc

SEQ ID NO: 8577 - DNA, 22 bp, Artificial Sequence
  Description of Artificial Sequence: Synthetic oligonucleotide
aggactccaattggagtcctcc

SEQ ID NO: 8578 - DNA, 22 bp, Artificial Sequence
  Description of Artificial Sequence: Synthetic oligonucleotide
cagactccaattggagtctgcc

SEQ ID NO: 8579 - DNA, 22 bp, Artificial Sequence
  Description of Artificial Sequence: Synthetic oligonucleotide
cggactccaattggagtccgca

SEQ ID NO: 8580 - DNA, 22 bp, Artificial Sequence
  Description of Artificial Sequence: Synthetic oligonucleotide
cggactccaattggagtccgac

SEQ ID NO: 8581 - DNA, 22 bp, Artificial Sequence
  Description of Artificial Sequence: Synthetic oligonucleotide
tggactccaattggagtccacc

SEQ ID NO: 8582 - DNA, 22 bp, Artificial Sequence
  Description of Artificial Sequence: Synthetic oligonucleotide
ctgactccaattggagtcagcc

SEQ ID NO: 8583 - DNA, 22 bp, Artificial Sequence
  Description of Artificial Sequence: Synthetic oligonucleotide
ccgactccaattggagtcgggc

SEQ ID NO: 8584 - DNA, 22 bp, Artificial Sequence
  Description of Artificial Sequence: Synthetic oligonucleotide
ccgactccaattggagtcgggt

SEQ ID NO: 8585 - DNA, 22 bp, Artificial Sequence
  Description of Artificial Sequence: Synthetic oligonucleotide
ccgactccaattggagtcggtc

SEQ ID NO: 8586 - DNA, 22 bp, Artificial Sequence
  Description of Artificial Sequence: Synthetic oligonucleotide
acgactccaattggagtcgtgc

SEQ ID NO: 8587 - DNA, 22 bp, Artificial Sequence
  Description of Artificial Sequence: Synthetic oligonucleotide
cagactccaattggagtctggc

SEQ ID NO: 8588 - DNA, 22 bp, Artificial Sequence
  Description of Artificial Sequence: Synthetic oligonucleotide
ccgactccaattggagtcggga

SEQ ID NO: 8589 - DNA, 22 bp, Artificial Sequence
  Description of Artificial Sequence: Synthetic oligonucleotide
ccgactccaattggagtcggac

SEQ ID NO: 8590 - DNA, 22 bp, Artificial Sequence
  Description of Artificial Sequence: Synthetic oligonucleotide
ctgactccaattggagtcaggc

SEQ ID NO: 8591 - DNA, 22 bp, Artificial Sequence
  Description of Artificial Sequence: Synthetic oligonucleotide
gcgactccaattggagtcgccc

SEQ ID NO: 8592 - DNA, 22 bp, Artificial Sequence
  Description of Artificial Sequence: Synthetic oligonucleotide
gcgactccaattggagtcgcct

SEQ ID NO: 8593 - DNA, 22 bp, Artificial Sequence
  Description of Artificial Sequence: Synthetic oligonucleotide
gcgactccaattggagtcgctc

SEQ ID NO: 8594 - DNA, 22 bp, Artificial Sequence
  Description of Artificial Sequence: Synthetic oligonucleotide
acgactccaattggagtcgtcc

SEQ ID NO: 8595 - DNA, 22 bp, Artificial Sequence
  Description of Artificial Sequence: Synthetic oligonucleotide
gagactccaattggagtctccc

SEQ ID NO: 8596 - DNA, 22 bp, Artificial Sequence
  Description of Artificial Sequence: Synthetic oligonucleotide
gcgactccaattggagtcgcca

SEQ ID NO: 8597 - DNA, 22 bp, Artificial Sequence
  Description of Artificial Sequence: Synthetic oligonucleotide
gcgactccaattggagtcgcac

SEQ ID NO: 8598 - DNA, 22 bp, Artificial Sequence
  Description of Artificial Sequence: Synthetic oligonucleotide
gtgactccaattggagtcaccc

SEQ ID NO: 8599 - DNA, 22 bp, Artificial Sequence
  Description of Artificial Sequence: Synthetic oligonucleotide
gggactccaattggagtcccgt

SEQ ID NO: 8600 - DNA, 22 bp, Artificial Sequence
  Description of Artificial Sequence: Synthetic oligonucleotide
gggactccaattggagtccctg

SEQ ID NO: 8601 - DNA, 22 bp, Artificial Sequence
  Description of Artificial Sequence: Synthetic oligonucleotide
aggactccaattggagtcctgg

SEQ ID NO: 8602 - DNA, 22 bp, Artificial Sequence
  Description of Artificial Sequence: Synthetic oligonucleotide
gagactccaattggagtctcgg

SEQ ID NO: 8603 - DNA, 22 bp, Artificial Sequence
  Description of Artificial Sequence: Synthetic oligonucleotide
gggactccaattggagtcccga

SEQ ID NO: 8604 - DNA, 22 bp, Artificial Sequence
  Description of Artificial Sequence: Synthetic oligonucleotide
gggactccaattggagtcccag

SEQ ID NO: 8605 - DNA, 22 bp, Artificial Sequence
  Description of Artificial Sequence: Synthetic oligonucleotide
tggactccaattggagtccagg

SEQ ID NO: 8606 - DNA, 22 bp, Artificial Sequence
  Description of Artificial Sequence: Synthetic oligonucleotide
gtgactccaattggagtcacgg

SEQ ID NO: 8607 - DNA, 22 bp, Artificial Sequence
  Description of Artificial Sequence: Synthetic oligonucleotide
gcgactccaattggagtcgccg

SEQ ID NO: 8608 - DNA, 22 bp, Artificial Sequence
  Description of Artificial Sequence: Synthetic oligonucleotide
gcgactccaattggagtcgctg

SEQ ID NO: 8609 - DNA, 22 bp, Artificial Sequence
  Description of Artificial Sequence: Synthetic oligonucleotide
acgactccaattggagtcgtcg

SEQ ID NO: 8610 - DNA, 22 bp, Artificial Sequence
  Description of Artificial Sequence: Synthetic oligonucleotide
gagactccaattggagtctccg

SEQ ID NO: 8611 - DNA, 22 bp, Artificial Sequence
  Description of Artificial Sequence: Synthetic oligonucleotide
gcgactccaattggagtcgcag

SEQ ID NO: 8612 - DNA, 22 bp, Artificial Sequence
  Description of Artificial Sequence: Synthetic oligonucleotide
gtgactccaattggagtcaccg

SEQ ID NO: 8613 - DNA, 22 bp, Artificial Sequence
  Description of Artificial Sequence: Synthetic oligonucleotide
cggactccaattggagtccgtg

SEQ ID NO: 8614 - DNA, 22 bp, Artificial Sequence
  Description of Artificial Sequence: Synthetic oligonucleotide
cagactccaattggagtctggg

SEQ ID NO: 8615 - DNA, 22 bp, Artificial Sequence
  Description of Artificial Sequence: Synthetic oligonucleotide
cggactccaattggagtccgag

SEQ ID NO: 8616 - DNA, 22 bp, Artificial Sequence
  Description of Artificial Sequence: Synthetic oligonucleotide
ctgactccaattggagtcaggg

SEQ ID NO: 8617 - DNA, 22 bp, Artificial Sequence
  Description of Artificial Sequence: Synthetic oligonucleotide
acgactccaattggagtcgtgg

SEQ ID NO: 8618 - DNA, 22 bp, Artificial Sequence
  Description of Artificial Sequence: Synthetic oligonucleotide
ccgactccaattggagtcggct

SEQ ID NO: 8619 - DNA, 22 bp, Artificial Sequence
  Description of Artificial Sequence: Synthetic oligonucleotide
ccgactccaattggagtcggca

SEQ ID NO: 8620 - DNA, 22 bp, Artificial Sequence
  Description of Artificial Sequence: Synthetic oligonucleotide
gagactccaattggagtctcgc

SEQ ID NO: 8621 - DNA, 22 bp, Artificial Sequence
  Description of Artificial Sequence: Synthetic oligonucleotide
gtgactccaattggagtcacgc

SEQ ID NO: 8622 - DNA, 22 bp, Artificial Sequence
  Description of Artificial Sequence: Synthetic oligonucleotide
aggactccaattggagtcctgc

SEQ ID NO: 8623 - DNA, 22 bp, Artificial Sequence
  Description of Artificial Sequence: Synthetic oligonucleotide
tggactccaattggagtccagc

SEQ ID NO: 8624 - DNA, 22 bp, Artificial Sequence
  Description of Artificial Sequence: Synthetic oligonucleotide
aggactccaattggagtcctcg

SEQ ID NO: 8625 - DNA, 22 bp, Artificial Sequence
  Description of Artificial Sequence: Synthetic oligonucleotide
tggactccaattggagtccacg

SEQ ID NO: 8626 - DNA, 22 bp, Artificial Sequence
  Description of Artificial Sequence: Synthetic oligonucleotide
ccgactccaattggagtcggtg

SEQ ID NO: 8627 - DNA, 22 bp, Artificial Sequence
  Description of Artificial Sequence: Synthetic oligonucleotide
ccgactccaattggagtcggag

SEQ ID NO: 8628 - DNA, 22 bp, Artificial Sequence
  Description of Artificial Sequence: Synthetic oligonucleotide
gggactccaattggagtcccgc

SEQ ID NO: 8629 - DNA, 22 bp, Artificial Sequence
  Description of Artificial Sequence: Synthetic oligonucleotide
gggactccaattggagtccctc

SEQ ID NO: 8630 - DNA, 22 bp, Artificial Sequence
  Description of Artificial Sequence: Synthetic oligonucleotide
gggactccaattggagtcccac

SEQ ID NO: 8631 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccatatggagtcnnnn

SEQ ID NO: 8632 - DNA, 22 bp, Artificial Sequence
  Description of Artificial Sequence: Synthetic oligonucleotide
cggactccatatggagtccgcc

SEQ ID NO: 8633 - DNA, 22 bp, Artificial Sequence
  Description of Artificial Sequence: Synthetic oligonucleotide
cggactccatatggagtccgct

SEQ ID NO: 8634 - DNA, 22 bp, Artificial Sequence
  Description of Artificial Sequence: Synthetic oligonucleotide
cggactccatatggagtccgtc

SEQ ID NO: 8635 - DNA, 22 bp, Artificial Sequence
  Description of Artificial Sequence: Synthetic oligonucleotide
aggactccatatggagtcctcc

SEQ ID NO: 8636 - DNA, 22 bp, Artificial Sequence
  Description of Artificial Sequence: Synthetic oligonucleotide
cagactccatatggagtctgcc

SEQ ID NO: 8637 - DNA, 22 bp, Artificial Sequence
  Description of Artificial Sequence: Synthetic oligonucleotide
cggactccatatggagtccgca

SEQ ID NO: 8638 - DNA, 22 bp, Artificial Sequence
  Description of Artificial Sequence: Synthetic oligonucleotide
cggactccatatggagtccgac

SEQ ID NO: 8639 - DNA, 22 bp, Artificial Sequence
  Description of Artificial Sequence: Synthetic oligonucleotide
tggactccatatggagtccacc

SEQ ID NO: 8640 - DNA, 22 bp, Artificial Sequence
  Description of Artificial Sequence: Synthetic oligonucleotide
ctgactccatatggagtcagcc

SEQ ID NO: 8641 - DNA, 22 bp, Artificial Sequence
  Description of Artificial Sequence: Synthetic oligonucleotide
ccgactccatatggagtcgggc

SEQ ID NO: 8642 - DNA, 22 bp, Artificial Sequence
  Description of Artificial Sequence: Synthetic oligonucleotide
ccgactccatatggagtcgggt

SEQ ID NO: 8643 - DNA, 22 bp, Artificial Sequence
  Description of Artificial Sequence: Synthetic oligonucleotide
ccgactccatatggagtcggtc

SEQ ID NO: 8644 - DNA, 22 bp, Artificial Sequence
  Description of Artificial Sequence: Synthetic oligonucleotide
acgactccatatggagtcgtgc

SEQ ID NO: 8645 - DNA, 22 bp, Artificial Sequence
  Description of Artificial Sequence: Synthetic oligonucleotide
cagactccatatggagtctggc

SEQ ID NO: 8646 - DNA, 22 bp, Artificial Sequence
  Description of Artificial Sequence: Synthetic oligonucleotide
ccgactccatatggagtcggga

SEQ ID NO: 8647 - DNA, 22 bp, Artificial Sequence
  Description of Artificial Sequence: Synthetic oligonucleotide
ccgactccatatggagtcggac

SEQ ID NO: 8648 - DNA, 22 bp, Artificial Sequence
  Description of Artificial Sequence: Synthetic oligonucleotide
ctgactccatatggagtcaggc

SEQ ID NO: 8649 - DNA, 22 bp, Artificial Sequence
  Description of Artificial Sequence: Synthetic oligonucleotide
gcgactccatatggagtcgccc

SEQ ID NO: 8650 - DNA, 22 bp, Artificial Sequence
  Description of Artificial Sequence: Synthetic oligonucleotide
gcgactccatatggagtcgcct

SEQ ID NO: 8651 - DNA, 22 bp, Artificial Sequence
  Description of Artificial Sequence: Synthetic oligonucleotide
gcgactccatatggagtcgctc

SEQ ID NO: 8652 - DNA, 22 bp, Artificial Sequence
  Description of Artificial Sequence: Synthetic oligonucleotide
acgactccatatggagtcgtcc

SEQ ID NO: 8653 - DNA, 22 bp, Artificial Sequence
  Description of Artificial Sequence: Synthetic oligonucleotide
gagactccatatggagtctccc

SEQ ID NO: 8654 - DNA, 22 bp, Artificial Sequence
  Description of Artificial Sequence: Synthetic oligonucleotide
gcgactccatatggagtcgcca

SEQ ID NO: 8655 - DNA, 22 bp, Artificial Sequence
  Description of Artificial Sequence: Synthetic oligonucleotide
gcgactccatatggagtcgcac

SEQ ID NO: 8656 - DNA, 22 bp, Artificial Sequence
  Description of Artificial Sequence: Synthetic oligonucleotide
gtgactccatatggagtcaccc

SEQ ID NO: 8657 - DNA, 22 bp, Artificial Sequence
  Description of Artificial Sequence: Synthetic oligonucleotide
gggactccatatggagtcccgt

SEQ ID NO: 8658 - DNA, 22 bp, Artificial Sequence
  Description of Artificial Sequence: Synthetic oligonucleotide
gggactccatatggagtccctg

SEQ ID NO: 8659 - DNA, 22 bp, Artificial Sequence
  Description of Artificial Sequence: Synthetic oligonucleotide
aggactccatatggagtcctgg

SEQ ID NO: 8660 - DNA, 22 bp, Artificial Sequence
  Description of Artificial Sequence: Synthetic oligonucleotide
gagactccatatggagtctcgg

SEQ ID NO: 8661 - DNA, 22 bp, Artificial Sequence
  Description of Artificial Sequence: Synthetic oligonucleotide
gggactccatatggagtcccga

SEQ ID NO: 8662 - DNA, 22 bp, Artificial Sequence
  Description of Artificial Sequence: Synthetic oligonucleotide
gggactccatatggagtcccag

SEQ ID NO: 8663 - DNA, 22 bp, Artificial Sequence
  Description of Artificial Sequence: Synthetic oligonucleotide
tggactccatatggagtccagg

SEQ ID NO: 8664 - DNA, 22 bp, Artificial Sequence
  Description of Artificial Sequence: Synthetic oligonucleotide
gtgactccatatggagtcacgg

SEQ ID NO: 8665 - DNA, 22 bp, Artificial Sequence
  Description of Artificial Sequence: Synthetic oligonucleotide
gcgactccatatggagtcgccg

SEQ ID NO: 8666 - DNA, 22 bp, Artificial Sequence
  Description of Artificial Sequence: Synthetic oligonucleotide
gcgactccatatggagtcgctg

SEQ ID NO: 8667 - DNA, 22 bp, Artificial Sequence
  Description of Artificial Sequence: Synthetic oligonucleotide
acgactccatatggagtcgtcg

SEQ ID NO: 8668 - DNA, 22 bp, Artificial Sequence
  Description of Artificial Sequence: Synthetic oligonucleotide
gagactccatatggagtctccg

SEQ ID NO: 8669 - DNA, 22 bp, Artificial Sequence
  Description of Artificial Sequence: Synthetic oligonucleotide
gcgactccatatggagtcgcag

SEQ ID NO: 8670 - DNA, 22 bp, Artificial Sequence
  Description of Artificial Sequence: Synthetic oligonucleotide
gtgactccatatggagtcaccg

SEQ ID NO: 8671 - DNA, 22 bp, Artificial Sequence
  Description of Artificial Sequence: Synthetic oligonucleotide
cggactccatatggagtccgtg

SEQ ID NO: 8672 - DNA, 22 bp, Artificial Sequence
  Description of Artificial Sequence: Synthetic oligonucleotide
cagactccatatggagtctggg

SEQ ID NO: 8673 - DNA, 22 bp, Artificial Sequence
  Description of Artificial Sequence: Synthetic oligonucleotide
cggactccatatggagtccgag

SEQ ID NO: 8674 - DNA, 22 bp, Artificial Sequence
  Description of Artificial Sequence: Synthetic oligonucleotide
ctgactccatatggagtcaggg

SEQ ID NO: 8675 - DNA, 22 bp, Artificial Sequence
  Description of Artificial Sequence: Synthetic oligonucleotide
acgactccatatggagtcgtgg

SEQ ID NO: 8676 - DNA, 22 bp, Artificial Sequence
  Description of Artificial Sequence: Synthetic oligonucleotide
ccgactccatatggagtcggct

SEQ ID NO: 8677 - DNA, 22 bp, Artificial Sequence
  Description of Artificial Sequence: Synthetic oligonucleotide
ccgactccatatggagtcggca

SEQ ID NO: 8678 - DNA, 22 bp, Artificial Sequence
  Description of Artificial Sequence: Synthetic oligonucleotide
gagactccatatggagtctcgc

SEQ ID NO: 8679 - DNA, 22 bp, Artificial Sequence
  Description of Artificial Sequence: Synthetic oligonucleotide
gtgactccatatggagtcacgc

SEQ ID NO: 8680 - DNA, 22 bp, Artificial Sequence
  Description of Artificial Sequence: Synthetic oligonucleotide
aggactccatatggagtcctgc

SEQ ID NO: 8681 - DNA, 22 bp, Artificial Sequence
  Description of Artificial Sequence: Synthetic oligonucleotide
tggactccatatggagtccagc

SEQ ID NO: 8682 - DNA, 22 bp, Artificial Sequence
  Description of Artificial Sequence: Synthetic oligonucleotide
aggactccatatggagtcctcg

SEQ ID NO: 8683 - DNA, 22 bp, Artificial Sequence
  Description of Artificial Sequence: Synthetic oligonucleotide
tggactccatatggagtccacg

SEQ ID NO: 8684 - DNA, 22 bp, Artificial Sequence
  Description of Artificial Sequence: Synthetic oligonucleotide
ccgactccatatggagtcggtg

SEQ ID NO: 8685 - DNA, 22 bp, Artificial Sequence
  Description of Artificial Sequence: Synthetic oligonucleotide
ccgactccatatggagtcggag

SEQ ID NO: 8686 - DNA, 22 bp, Artificial Sequence
  Description of Artificial Sequence: Synthetic oligonucleotide
gggactccatatggagtcccgc

SEQ ID NO: 8687 - DNA, 22 bp, Artificial Sequence
  Description of Artificial Sequence: Synthetic oligonucleotide
gggactccatatggagtccctc

SEQ ID NO: 8688 - DNA, 22 bp, Artificial Sequence
  Description of Artificial Sequence: Synthetic oligonucleotide
gggactccatatggagtcccac

SEQ ID NO: 8689 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccagctggagtcnnnn

SEQ ID NO: 8690 - DNA, 22 bp, Artificial Sequence
  Description of Artificial Sequence: Synthetic oligonucleotide
cggactccagctggagtccgcc

SEQ ID NO: 8691 - DNA, 22 bp, Artificial Sequence
  Description of Artificial Sequence: Synthetic oligonucleotide
cggactccagctggagtccgct

SEQ ID NO: 8692 - DNA, 22 bp, Artificial Sequence
  Description of Artificial Sequence: Synthetic oligonucleotide
cggactccagctggagtccgtc

SEQ ID NO: 8693 - DNA, 22 bp, Artificial Sequence
  Description of Artificial Sequence: Synthetic oligonucleotide
aggactccagctggagtcctcc

SEQ ID NO: 8694 - DNA, 22 bp, Artificial Sequence
  Description of Artificial Sequence: Synthetic oligonucleotide
cagactccagctggagtctgcc

SEQ ID NO: 8695 - DNA, 22 bp, Artificial Sequence
  Description of Artificial Sequence: Synthetic oligonucleotide
cggactccagctggagtccgca

SEQ ID NO: 8696 - DNA, 22 bp, Artificial Sequence
  Description of Artificial Sequence: Synthetic oligonucleotide
cggactccagctggagtccgac

SEQ ID NO: 8697 - DNA, 22 bp, Artificial Sequence
  Description of Artificial Sequence: Synthetic oligonucleotide
tggactccagctggagtccacc

SEQ ID NO: 8698 - DNA, 22 bp, Artificial Sequence
  Description of Artificial Sequence: Synthetic oligonucleotide
ctgactccagctggagtcagcc

SEQ ID NO: 8699 - DNA, 22 bp, Artificial Sequence
  Description of Artificial Sequence: Synthetic oligonucleotide
ccgactccagctggagtcgggc

SEQ ID NO: 8700 - DNA, 22 bp, Artificial Sequence
  Description of Artificial Sequence: Synthetic oligonucleotide
ccgactccagctggagtcgggt

SEQ ID NO: 8701 - DNA, 22 bp, Artificial Sequence
  Description of Artificial Sequence: Synthetic oligonucleotide
ccgactccagctggagtcggtc

SEQ ID NO: 8702 - DNA, 22 bp, Artificial Sequence
  Description of Artificial Sequence: Synthetic oligonucleotide
acgactccagctggagtcgtgc

SEQ ID NO: 8703 - DNA, 22 bp, Artificial Sequence
  Description of Artificial Sequence: Synthetic oligonucleotide
cagactccagctggagtctggc

SEQ ID NO: 8704 - DNA, 22 bp, Artificial Sequence
  Description of Artificial Sequence: Synthetic oligonucleotide
ccgactccagctggagtcggga

SEQ ID NO: 8705 - DNA, 22 bp, Artificial Sequence
  Description of Artificial Sequence: Synthetic oligonucleotide
ccgactccagctggagtcggac

SEQ ID NO: 8706 - DNA, 22 bp, Artificial Sequence
  Description of Artificial Sequence: Synthetic oligonucleotide
ctgactccagctggagtcaggc

SEQ ID NO: 8707 - DNA, 22 bp, Artificial Sequence
  Description of Artificial Sequence: Synthetic oligonucleotide
gcgactccagctggagtcgccc

SEQ ID NO: 8708 - DNA, 22 bp, Artificial Sequence
  Description of Artificial Sequence: Synthetic oligonucleotide
gcgactccagctggagtcgcct

SEQ ID NO: 8709 - DNA, 22 bp, Artificial Sequence
  Description of Artificial Sequence: Synthetic oligonucleotide
gcgactccagctggagtcgctc

SEQ ID NO: 8710 - DNA, 22 bp, Artificial Sequence
  Description of Artificial Sequence: Synthetic oligonucleotide
acgactccagctggagtcgtcc

SEQ ID NO: 8711 - DNA, 22 bp, Artificial Sequence
  Description of Artificial Sequence: Synthetic oligonucleotide
gagactccagctggagtctccc

SEQ ID NO: 8712 - DNA, 22 bp, Artificial Sequence
  Description of Artificial Sequence: Synthetic oligonucleotide
gcgactccagctggagtcgcca

SEQ ID NO: 8713 - DNA, 22 bp, Artificial Sequence
  Description of Artificial Sequence: Synthetic oligonucleotide
gcgactccagctggagtcgcac

SEQ ID NO: 8714 - DNA, 22 bp, Artificial Sequence
  Description of Artificial Sequence: Synthetic oligonucleotide
gtgactccagctggagtcaccc

SEQ ID NO: 8715 - DNA, 22 bp, Artificial Sequence
  Description of Artificial Sequence: Synthetic oligonucleotide
gggactccagctggagtcccgt

SEQ ID NO: 8716 - DNA, 22 bp, Artificial Sequence
  Description of Artificial Sequence: Synthetic oligonucleotide
gggactccagctggagtccctg

SEQ ID NO: 8717 - DNA, 22 bp, Artificial Sequence
  Description of Artificial Sequence: Synthetic oligonucleotide
aggactccagctggagtcctgg

SEQ ID NO: 8718 - DNA, 22 bp, Artificial Sequence
  Description of Artificial Sequence: Synthetic oligonucleotide
gagactccagctggagtctcgg

SEQ ID NO: 8719 - DNA, 22 bp, Artificial Sequence
  Description of Artificial Sequence: Synthetic oligonucleotide
gggactccagctggagtcccga

SEQ ID NO: 8720 - DNA, 22 bp, Artificial Sequence
  Description of Artificial Sequence: Synthetic oligonucleotide
gggactccagctggagtcccag

SEQ ID NO: 8721 - DNA, 22 bp, Artificial Sequence
  Description of Artificial Sequence: Synthetic oligonucleotide
tggactccagctggagtccagg

SEQ ID NO: 8722 - DNA, 22 bp, Artificial Sequence
  Description of Artificial Sequence: Synthetic oligonucleotide
gtgactccagctggagtcacgg

SEQ ID NO: 8723 - DNA, 22 bp, Artificial Sequence
  Description of Artificial Sequence: Synthetic oligonucleotide
gcgactccagctggagtcgccg

SEQ ID NO: 8724 - DNA, 22 bp, Artificial Sequence
  Description of Artificial Sequence: Synthetic oligonucleotide
gcgactccagctggagtcgctg

SEQ ID NO: 8725 - DNA, 22 bp, Artificial Sequence
  Description of Artificial Sequence: Synthetic oligonucleotide
acgactccagctggagtcgtcg

SEQ ID NO: 8726 - DNA, 22 bp, Artificial Sequence
  Description of Artificial Sequence: Synthetic oligonucleotide
gagactccagctggagtctccg

SEQ ID NO: 8727 - DNA, 22 bp, Artificial Sequence
  Description of Artificial Sequence: Synthetic oligonucleotide
gcgactccagctggagtcgcag

SEQ ID NO: 8728 - DNA, 22 bp, Artificial Sequence
  Description of Artificial Sequence: Synthetic oligonucleotide
gtgactccagctggagtcaccg

SEQ ID NO: 8729 - DNA, 22 bp, Artificial Sequence
  Description of Artificial Sequence: Synthetic oligonucleotide
cggactccagctggagtccgtg

SEQ ID NO: 8730 - DNA, 22 bp, Artificial Sequence
  Description of Artificial Sequence: Synthetic oligonucleotide
cagactccagctggagtctggg

SEQ ID NO: 8731 - DNA, 22 bp, Artificial Sequence
  Description of Artificial Sequence: Synthetic oligonucleotide
cggactccagctggagtccgag

SEQ ID NO: 8732 - DNA, 22 bp, Artificial Sequence
  Description of Artificial Sequence: Synthetic oligonucleotide
ctgactccagctggagtcaggg

SEQ ID NO: 8733 - DNA, 22 bp, Artificial Sequence
  Description of Artificial Sequence: Synthetic oligonucleotide
acgactccagctggagtcgtgg

SEQ ID NO: 8734 - DNA, 22 bp, Artificial Sequence
  Description of Artificial Sequence: Synthetic oligonucleotide
ccgactccagctggagtcggct

SEQ ID NO: 8735 - DNA, 22 bp, Artificial Sequence
  Description of Artificial Sequence: Synthetic oligonucleotide
ccgactccagctggagtcggca

SEQ ID NO: 8736 - DNA, 22 bp, Artificial Sequence
  Description of Artificial Sequence: Synthetic oligonucleotide
gagactccagctggagtctcgc

SEQ ID NO: 8737 - DNA, 22 bp, Artificial Sequence
  Description of Artificial Sequence: Synthetic oligonucleotide
gtgactccagctggagtcacgc

SEQ ID NO: 8738 - DNA, 22 bp, Artificial Sequence
  Description of Artificial Sequence: Synthetic oligonucleotide
aggactccagctggagtcctgc

SEQ ID NO: 8739 - DNA, 22 bp, Artificial Sequence
  Description of Artificial Sequence: Synthetic oligonucleotide
tggactccagctggagtccagc

SEQ ID NO: 8740 - DNA, 22 bp, Artificial Sequence
  Description of Artificial Sequence: Synthetic oligonucleotide
aggactccagctggagtcctcg

SEQ ID NO: 8741 - DNA, 22 bp, Artificial Sequence
  Description of Artificial Sequence: Synthetic oligonucleotide
tggactccagctggagtccacg

SEQ ID NO: 8742 - DNA, 22 bp, Artificial Sequence
  Description of Artificial Sequence: Synthetic oligonucleotide
ccgactccagctggagtcggtg

SEQ ID NO: 8743 - DNA, 22 bp, Artificial Sequence
  Description of Artificial Sequence: Synthetic oligonucleotide
ccgactccagctggagtcggag

SEQ ID NO: 8744 - DNA, 22 bp, Artificial Sequence
  Description of Artificial Sequence: Synthetic oligonucleotide
gggactccagctggagtcccgc

SEQ ID NO: 8745 - DNA, 22 bp, Artificial Sequence
  Description of Artificial Sequence: Synthetic oligonucleotide
gggactccagctggagtccctc

SEQ ID NO: 8746 - DNA, 22 bp, Artificial Sequence
  Description of Artificial Sequence: Synthetic oligonucleotide
gggactccagctggagtcccac

SEQ ID NO: 8747 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactccacgtggagtcnnnn

SEQ ID NO: 8748 - DNA, 22 bp, Artificial Sequence
  Description of Artificial Sequence: Synthetic oligonucleotide
cggactccacgtggagtccgcc

SEQ ID NO: 8749 - DNA, 22 bp, Artificial Sequence
  Description of Artificial Sequence: Synthetic oligonucleotide
cggactccacgtggagtccgct

SEQ ID NO: 8750 - DNA, 22 bp, Artificial Sequence
  Description of Artificial Sequence: Synthetic oligonucleotide
cggactccacgtggagtccgtc

SEQ ID NO: 8751 - DNA, 22 bp, Artificial Sequence
  Description of Artificial Sequence: Synthetic oligonucleotide
aggactccacgtggagtcctcc

SEQ ID NO: 8752 - DNA, 22 bp, Artificial Sequence
  Description of Artificial Sequence: Synthetic oligonucleotide
cagactccacgtggagtctgcc

SEQ ID NO: 8753 - DNA, 22 bp, Artificial Sequence
  Description of Artificial Sequence: Synthetic oligonucleotide
cggactccacgtggagtccgca

SEQ ID NO: 8754 - DNA, 22 bp, Artificial Sequence
  Description of Artificial Sequence: Synthetic oligonucleotide
cggactccacgtggagtccgac

SEQ ID NO: 8755 - DNA, 22 bp, Artificial Sequence
  Description of Artificial Sequence: Synthetic oligonucleotide
tggactccacgtggagtccacc

SEQ ID NO: 8756 - DNA, 22 bp, Artificial Sequence
  Description of Artificial Sequence: Synthetic oligonucleotide
ctgactccacgtggagtcagcc

SEQ ID NO: 8757 - DNA, 22 bp, Artificial Sequence
  Description of Artificial Sequence: Synthetic oligonucleotide
ccgactccacgtggagtcgggc

SEQ ID NO: 8758 - DNA, 22 bp, Artificial Sequence
  Description of Artificial Sequence: Synthetic oligonucleotide
ccgactccacgtggagtcgggt

SEQ ID NO: 8759 - DNA, 22 bp, Artificial Sequence
  Description of Artificial Sequence: Synthetic oligonucleotide
ccgactccacgtggagtcggtc

SEQ ID NO: 8760 - DNA, 22 bp, Artificial Sequence
  Description of Artificial Sequence: Synthetic oligonucleotide
acgactccacgtggagtcgtgc

SEQ ID NO: 8761 - DNA, 22 bp, Artificial Sequence
  Description of Artificial Sequence: Synthetic oligonucleotide
cagactccacgtggagtctggc

SEQ ID NO: 8762 - DNA, 22 bp, Artificial Sequence
  Description of Artificial Sequence: Synthetic oligonucleotide
ccgactccacgtggagtcggga

SEQ ID NO: 8763 - DNA, 22 bp, Artificial Sequence
  Description of Artificial Sequence: Synthetic oligonucleotide
ccgactccacgtggagtcggac

SEQ ID NO: 8764 - DNA, 22 bp, Artificial Sequence
  Description of Artificial Sequence: Synthetic oligonucleotide
ctgactccacgtggagtcaggc

SEQ ID NO: 8765 - DNA, 22 bp, Artificial Sequence
  Description of Artificial Sequence: Synthetic oligonucleotide
gcgactccacgtggagtcgccc

SEQ ID NO: 8766 - DNA, 22 bp, Artificial Sequence
  Description of Artificial Sequence: Synthetic oligonucleotide
gcgactccacgtggagtcgcct

SEQ ID NO: 8767 - DNA, 22 bp, Artificial Sequence
  Description of Artificial Sequence: Synthetic oligonucleotide
gcgactccacgtggagtcgctc

SEQ ID NO: 8768 - DNA, 22 bp, Artificial Sequence
  Description of Artificial Sequence: Synthetic oligonucleotide
acgactccacgtggagtcgtcc

SEQ ID NO: 8769 - DNA, 22 bp, Artificial Sequence
  Description of Artificial Sequence: Synthetic oligonucleotide
gagactccacgtggagtctccc

SEQ ID NO: 8770 - DNA, 22 bp, Artificial Sequence
  Description of Artificial Sequence: Synthetic oligonucleotide
gcgactccacgtggagtcgcca

SEQ ID NO: 8771 - DNA, 22 bp, Artificial Sequence
  Description of Artificial Sequence: Synthetic oligonucleotide
gcgactccacgtggagtcgcac

SEQ ID NO: 8772 - DNA, 22 bp, Artificial Sequence
  Description of Artificial Sequence: Synthetic oligonucleotide
gtgactccacgtggagtcaccc

SEQ ID NO: 8773 - DNA, 22 bp, Artificial Sequence
  Description of Artificial Sequence: Synthetic oligonucleotide
gggactccacgtggagtcccgt

SEQ ID NO: 8774 - DNA, 22 bp, Artificial Sequence
  Description of Artificial Sequence: Synthetic oligonucleotide
gggactccacgtggagtccctg

SEQ ID NO: 8775 - DNA, 22 bp, Artificial Sequence
  Description of Artificial Sequence: Synthetic oligonucleotide
aggactccacgtggagtcctgg

SEQ ID NO: 8776 - DNA, 22 bp, Artificial Sequence
  Description of Artificial Sequence: Synthetic oligonucleotide
gagactccacgtggagtctcgg

SEQ ID NO: 8777 - DNA, 22 bp, Artificial Sequence
  Description of Artificial Sequence: Synthetic oligonucleotide
gggactccacgtggagtcccga

SEQ ID NO: 8778 - DNA, 22 bp, Artificial Sequence
  Description of Artificial Sequence: Synthetic oligonucleotide
gggactccacgtggagtcccag

SEQ ID NO: 8779 - DNA, 22 bp, Artificial Sequence
  Description of Artificial Sequence: Synthetic oligonucleotide
tggactccacgtggagtccagg

SEQ ID NO: 8780 - DNA, 22 bp, Artificial Sequence
  Description of Artificial Sequence: Synthetic oligonucleotide
gtgactccacgtggagtcacgg

SEQ ID NO: 8781 - DNA, 22 bp, Artificial Sequence
  Description of Artificial Sequence: Synthetic oligonucleotide
gcgactccacgtggagtcgccg

SEQ ID NO: 8782 - DNA, 22 bp, Artificial Sequence
  Description of Artificial Sequence: Synthetic oligonucleotide
gcgactccacgtggagtcgctg

SEQ ID NO: 8783 - DNA, 22 bp, Artificial Sequence
  Description of Artificial Sequence: Synthetic oligonucleotide
acgactccacgtggagtcgtcg

SEQ ID NO: 8784 - DNA, 22 bp, Artificial Sequence
  Description of Artificial Sequence: Synthetic oligonucleotide
gagactccacgtggagtctccg

SEQ ID NO: 8785 - DNA, 22 bp, Artificial Sequence
  Description of Artificial Sequence: Synthetic oligonucleotide
gcgactccacgtggagtcgcag

SEQ ID NO: 8786 - DNA, 22 bp, Artificial Sequence
  Description of Artificial Sequence: Synthetic oligonucleotide
gtgactccacgtggagtcaccg

SEQ ID NO: 8787 - DNA, 22 bp, Artificial Sequence
  Description of Artificial Sequence: Synthetic oligonucleotide
cggactccacgtggagtccgtg

SEQ ID NO: 8788 - DNA, 22 bp, Artificial Sequence
  Description of Artificial Sequence: Synthetic oligonucleotide
cagactccacgtggagtctggg

SEQ ID NO: 8789 - DNA, 22 bp, Artificial Sequence
  Description of Artificial Sequence: Synthetic oligonucleotide
cggactccacgtggagtccgag

SEQ ID NO: 8790 - DNA, 22 bp, Artificial Sequence
  Description of Artificial Sequence: Synthetic oligonucleotide
ctgactccacgtggagtcaggg

SEQ ID NO: 8791 - DNA, 22 bp, Artificial Sequence
  Description of Artificial Sequence: Synthetic oligonucleotide
acgactccacgtggagtcgtgg

SEQ ID NO: 8792 - DNA, 22 bp, Artificial Sequence
  Description of Artificial Sequence: Synthetic oligonucleotide
ccgactccacgtggagtcggct

SEQ ID NO: 8793 - DNA, 22 bp, Artificial Sequence
  Description of Artificial Sequence: Synthetic oligonucleotide
ccgactccacgtggagtcggca

SEQ ID NO: 8794 - DNA, 22 bp, Artificial Sequence
  Description of Artificial Sequence: Synthetic oligonucleotide
gagactccacgtggagtctcgc

SEQ ID NO: 8795 - DNA, 22 bp, Artificial Sequence
  Description of Artificial Sequence: Synthetic oligonucleotide
gtgactccacgtggagtcacgc

SEQ ID NO: 8796 - DNA, 22 bp, Artificial Sequence
  Description of Artificial Sequence: Synthetic oligonucleotide
aggactccacgtggagtcctgc

SEQ ID NO: 8797 - DNA, 22 bp, Artificial Sequence
  Description of Artificial Sequence: Synthetic oligonucleotide
tggactccacgtggagtccagc

SEQ ID NO: 8798 - DNA, 22 bp, Artificial Sequence
  Description of Artificial Sequence: Synthetic oligonucleotide
aggactccacgtggagtcctcg

SEQ ID NO: 8799 - DNA, 22 bp, Artificial Sequence
  Description of Artificial Sequence: Synthetic oligonucleotide
tggactccacgtggagtccacg

SEQ ID NO: 8800 - DNA, 22 bp, Artificial Sequence
  Description of Artificial Sequence: Synthetic oligonucleotide
ccgactccacgtggagtcggtg

SEQ ID NO: 8801 - DNA, 22 bp, Artificial Sequence
  Description of Artificial Sequence: Synthetic oligonucleotide
ccgactccacgtggagtcggag

SEQ ID NO: 8802 - DNA, 22 bp, Artificial Sequence
  Description of Artificial Sequence: Synthetic oligonucleotide
gggactccacgtggagtcccgc

SEQ ID NO: 8803 - DNA, 22 bp, Artificial Sequence
  Description of Artificial Sequence: Synthetic oligonucleotide
gggactccacgtggagtccctc

SEQ ID NO: 8804 - DNA, 22 bp, Artificial Sequence
  Description of Artificial Sequence: Synthetic oligonucleotide
gggactccacgtggagtcccac

SEQ ID NO: 8805 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctcatgagagtcnnnn

SEQ ID NO: 8806 - DNA, 22 bp, Artificial Sequence
  Description of Artificial Sequence: Synthetic oligonucleotide
cggactctcatgagagtccgcc

SEQ ID NO: 8807 - DNA, 22 bp, Artificial Sequence
  Description of Artificial Sequence: Synthetic oligonucleotide
cggactctcatgagagtccgct

SEQ ID NO: 8808 - DNA, 22 bp, Artificial Sequence
  Description of Artificial Sequence: Synthetic oligonucleotide
cggactctcatgagagtccgtc

SEQ ID NO: 8809 - DNA, 22 bp, Artificial Sequence
  Description of Artificial Sequence: Synthetic oligonucleotide
aggactctcatgagagtcctcc

SEQ ID NO: 8810 - DNA, 22 bp, Artificial Sequence
  Description of Artificial Sequence: Synthetic oligonucleotide
cagactctcatgagagtctgcc

SEQ ID NO: 8811 - DNA, 22 bp, Artificial Sequence
  Description of Artificial Sequence: Synthetic oligonucleotide
cggactctcatgagagtccgca

SEQ ID NO: 8812 - DNA, 22 bp, Artificial Sequence
  Description of Artificial Sequence: Synthetic oligonucleotide
cggactctcatgagagtccgac

SEQ ID NO: 8813 - DNA, 22 bp, Artificial Sequence
  Description of Artificial Sequence: Synthetic oligonucleotide
tggactctcatgagagtccacc

SEQ ID NO: 8814 - DNA, 22 bp, Artificial Sequence
  Description of Artificial Sequence: Synthetic oligonucleotide
ctgactctcatgagagtcagcc

SEQ ID NO: 8815 - DNA, 22 bp, Artificial Sequence
  Description of Artificial Sequence: Synthetic oligonucleotide
ccgactctcatgagagtcgggc

SEQ ID NO: 8816 - DNA, 22 bp, Artificial Sequence
  Description of Artificial Sequence: Synthetic oligonucleotide
ccgactctcatgagagtcgggt

SEQ ID NO: 8817 - DNA, 22 bp, Artificial Sequence
  Description of Artificial Sequence: Synthetic oligonucleotide
ccgactctcatgagagtcggtc

SEQ ID NO: 8818 - DNA, 22 bp, Artificial Sequence
  Description of Artificial Sequence: Synthetic oligonucleotide
acgactctcatgagagtcgtgc

SEQ ID NO: 8819 - DNA, 22 bp, Artificial Sequence
  Description of Artificial Sequence: Synthetic oligonucleotide
cagactctcatgagagtctggc

SEQ ID NO: 8820 - DNA, 22 bp, Artificial Sequence
  Description of Artificial Sequence: Synthetic oligonucleotide
ccgactctcatgagagtcggga

SEQ ID NO: 8821 - DNA, 22 bp, Artificial Sequence
  Description of Artificial Sequence: Synthetic oligonucleotide
ccgactctcatgagagtcggac

SEQ ID NO: 8822 - DNA, 22 bp, Artificial Sequence
  Description of Artificial Sequence: Synthetic oligonucleotide
ctgactctcatgagagtcaggc

SEQ ID NO: 8823 - DNA, 22 bp, Artificial Sequence
  Description of Artificial Sequence: Synthetic oligonucleotide
gcgactctcatgagagtcgccc

SEQ ID NO: 8824 - DNA, 22 bp, Artificial Sequence
  Description of Artificial Sequence: Synthetic oligonucleotide
gcgactctcatgagagtcgcct

SEQ ID NO: 8825 - DNA, 22 bp, Artificial Sequence
  Description of Artificial Sequence: Synthetic oligonucleotide
gcgactctcatgagagtcgctc

SEQ ID NO: 8826 - DNA, 22 bp, Artificial Sequence
  Description of Artificial Sequence: Synthetic oligonucleotide
acgactctcatgagagtcgtcc

SEQ ID NO: 8827 - DNA, 22 bp, Artificial Sequence
  Description of Artificial Sequence: Synthetic oligonucleotide
gagactctcatgagagtctccc

SEQ ID NO: 8828 - DNA, 22 bp, Artificial Sequence
  Description of Artificial Sequence: Synthetic oligonucleotide
gcgactctcatgagagtcgcca

SEQ ID NO: 8829 - DNA, 22 bp, Artificial Sequence
  Description of Artificial Sequence: Synthetic oligonucleotide
gcgactctcatgagagtcgcac

SEQ ID NO: 8830 - DNA, 22 bp, Artificial Sequence
  Description of Artificial Sequence: Synthetic oligonucleotide
gtgactctcatgagagtcaccc

SEQ ID NO: 8831 - DNA, 22 bp, Artificial Sequence
  Description of Artificial Sequence: Synthetic oligonucleotide
gggactctcatgagagtcccgt

SEQ ID NO: 8832 - DNA, 22 bp, Artificial Sequence
  Description of Artificial Sequence: Synthetic oligonucleotide
gggactctcatgagagtccctg

SEQ ID NO: 8833 - DNA, 22 bp, Artificial Sequence
  Description of Artificial Sequence: Synthetic oligonucleotide
aggactctcatgagagtcctgg

SEQ ID NO: 8834 - DNA, 22 bp, Artificial Sequence
  Description of Artificial Sequence: Synthetic oligonucleotide
gagactctcatgagagtctcgg

SEQ ID NO: 8835 - DNA, 22 bp, Artificial Sequence
  Description of Artificial Sequence: Synthetic oligonucleotide
gggactctcatgagagtcccga

SEQ ID NO: 8836 - DNA, 22 bp, Artificial Sequence
  Description of Artificial Sequence: Synthetic oligonucleotide
gggactctcatgagagtcccag

SEQ ID NO: 8837 - DNA, 22 bp, Artificial Sequence
  Description of Artificial Sequence: Synthetic oligonucleotide
tggactctcatgagagtccagg

SEQ ID NO: 8838 - DNA, 22 bp, Artificial Sequence
  Description of Artificial Sequence: Synthetic oligonucleotide
gtgactctcatgagagtcacgg

SEQ ID NO: 8839 - DNA, 22 bp, Artificial Sequence
  Description of Artificial Sequence: Synthetic oligonucleotide
gcgactctcatgagagtcgccg

SEQ ID NO: 8840 - DNA, 22 bp, Artificial Sequence
  Description of Artificial Sequence: Synthetic oligonucleotide
gcgactctcatgagagtcgctg

SEQ ID NO: 8841 - DNA, 22 bp, Artificial Sequence
  Description of Artificial Sequence: Synthetic oligonucleotide
acgactctcatgagagtcgtcg

SEQ ID NO: 8842 - DNA, 22 bp, Artificial Sequence
  Description of Artificial Sequence: Synthetic oligonucleotide
gagactctcatgagagtctccg

SEQ ID NO: 8843 - DNA, 22 bp, Artificial Sequence
  Description of Artificial Sequence: Synthetic oligonucleotide
gcgactctcatgagagtcgcag

SEQ ID NO: 8844 - DNA, 22 bp, Artificial Sequence
  Description of Artificial Sequence: Synthetic oligonucleotide
gtgactctcatgagagtcaccg

SEQ ID NO: 8845 - DNA, 22 bp, Artificial Sequence
  Description of Artificial Sequence: Synthetic oligonucleotide
cggactctcatgagagtccgtg

SEQ ID NO: 8846 - DNA, 22 bp, Artificial Sequence
  Description of Artificial Sequence: Synthetic oligonucleotide
cagactctcatgagagtctggg

SEQ ID NO: 8847 - DNA, 22 bp, Artificial Sequence
  Description of Artificial Sequence: Synthetic oligonucleotide
cggactctcatgagagtccgag

SEQ ID NO: 8848 - DNA, 22 bp, Artificial Sequence
  Description of Artificial Sequence: Synthetic oligonucleotide
ctgactctcatgagagtcaggg

SEQ ID NO: 8849 - DNA, 22 bp, Artificial Sequence
  Description of Artificial Sequence: Synthetic oligonucleotide
acgactctcatgagagtcgtgg

SEQ ID NO: 8850 - DNA, 22 bp, Artificial Sequence
  Description of Artificial Sequence: Synthetic oligonucleotide
ccgactctcatgagagtcggct

SEQ ID NO: 8851 - DNA, 22 bp, Artificial Sequence
  Description of Artificial Sequence: Synthetic oligonucleotide
ccgactctcatgagagtcggca

SEQ ID NO: 8852 - DNA, 22 bp, Artificial Sequence
  Description of Artificial Sequence: Synthetic oligonucleotide
gagactctcatgagagtctcgc

SEQ ID NO: 8853 - DNA, 22 bp, Artificial Sequence
  Description of Artificial Sequence: Synthetic oligonucleotide
gtgactctcatgagagtcacgc

SEQ ID NO: 8854 - DNA, 22 bp, Artificial Sequence
  Description of Artificial Sequence: Synthetic oligonucleotide
aggactctcatgagagtcctgc

SEQ ID NO: 8855 - DNA, 22 bp, Artificial Sequence
  Description of Artificial Sequence: Synthetic oligonucleotide
tggactctcatgagagtccagc

SEQ ID NO: 8856 - DNA, 22 bp, Artificial Sequence
  Description of Artificial Sequence: Synthetic oligonucleotide
aggactctcatgagagtcctcg

SEQ ID NO: 8857 - DNA, 22 bp, Artificial Sequence
  Description of Artificial Sequence: Synthetic oligonucleotide
tggactctcatgagagtccacg

SEQ ID NO: 8858 - DNA, 22 bp, Artificial Sequence
  Description of Artificial Sequence: Synthetic oligonucleotide
ccgactctcatgagagtcggtg

SEQ ID NO: 8859 - DNA, 22 bp, Artificial Sequence
  Description of Artificial Sequence: Synthetic oligonucleotide
ccgactctcatgagagtcggag

SEQ ID NO: 8860 - DNA, 22 bp, Artificial Sequence
  Description of Artificial Sequence: Synthetic oligonucleotide
gggactctcatgagagtcccgc

SEQ ID NO: 8861 - DNA, 22 bp, Artificial Sequence
  Description of Artificial Sequence: Synthetic oligonucleotide
gggactctcatgagagtccctc

SEQ ID NO: 8862 - DNA, 22 bp, Artificial Sequence
  Description of Artificial Sequence: Synthetic oligonucleotide
gggactctcatgagagtcccac

SEQ ID NO: 8863 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctctagagagtcnnnn

SEQ ID NO: 8864 - DNA, 22 bp, Artificial Sequence
  Description of Artificial Sequence: Synthetic oligonucleotide
cggactctctagagagtccgcc

SEQ ID NO: 8865 - DNA, 22 bp, Artificial Sequence
  Description of Artificial Sequence: Synthetic oligonucleotide
cggactctctagagagtccgct

SEQ ID NO: 8866 - DNA, 22 bp, Artificial Sequence
  Description of Artificial Sequence: Synthetic oligonucleotide
cggactctctagagagtccgtc

SEQ ID NO: 8867 - DNA, 22 bp, Artificial Sequence
  Description of Artificial Sequence: Synthetic oligonucleotide
aggactctctagagagtcctcc

SEQ ID NO: 8868 - DNA, 22 bp, Artificial Sequence
  Description of Artificial Sequence: Synthetic oligonucleotide
cagactctctagagagtctgcc

SEQ ID NO: 8869 - DNA, 22 bp, Artificial Sequence
  Description of Artificial Sequence: Synthetic oligonucleotide
cggactctctagagagtccgca

SEQ ID NO: 8870 - DNA, 22 bp, Artificial Sequence
  Description of Artificial Sequence: Synthetic oligonucleotide
cggactctctagagagtccgac

SEQ ID NO: 8871 - DNA, 22 bp, Artificial Sequence
  Description of Artificial Sequence: Synthetic oligonucleotide
tggactctctagagagtccacc

SEQ ID NO: 8872 - DNA, 22 bp, Artificial Sequence
  Description of Artificial Sequence: Synthetic oligonucleotide
ctgactctctagagagtcagcc

SEQ ID NO: 8873 - DNA, 22 bp, Artificial Sequence
  Description of Artificial Sequence: Synthetic oligonucleotide
ccgactctctagagagtcgggc

SEQ ID NO: 8874 - DNA, 22 bp, Artificial Sequence
  Description of Artificial Sequence: Synthetic oligonucleotide
ccgactctctagagagtcgggt

SEQ ID NO: 8875 - DNA, 22 bp, Artificial Sequence
  Description of Artificial Sequence: Synthetic oligonucleotide
ccgactctctagagagtcggtc

SEQ ID NO: 8876 - DNA, 22 bp, Artificial Sequence
  Description of Artificial Sequence: Synthetic oligonucleotide
acgactctctagagagtcgtgc

SEQ ID NO: 8877 - DNA, 22 bp, Artificial Sequence
  Description of Artificial Sequence: Synthetic oligonucleotide
cagactctctagagagtctggc

SEQ ID NO: 8878 - DNA, 22 bp, Artificial Sequence
  Description of Artificial Sequence: Synthetic oligonucleotide
ccgactctctagagagtcggga

SEQ ID NO: 8879 - DNA, 22 bp, Artificial Sequence
  Description of Artificial Sequence: Synthetic oligonucleotide
ccgactctctagagagtcggac

SEQ ID NO: 8880 - DNA, 22 bp, Artificial Sequence
  Description of Artificial Sequence: Synthetic oligonucleotide
ctgactctctagagagtcaggc

SEQ ID NO: 8881 - DNA, 22 bp, Artificial Sequence
  Description of Artificial Sequence: Synthetic oligonucleotide
gcgactctctagagagtcgccc

SEQ ID NO: 8882 - DNA, 22 bp, Artificial Sequence
  Description of Artificial Sequence: Synthetic oligonucleotide
gcgactctctagagagtcgcct

SEQ ID NO: 8883 - DNA, 22 bp, Artificial Sequence
  Description of Artificial Sequence: Synthetic oligonucleotide
gcgactctctagagagtcgctc

SEQ ID NO: 8884 - DNA, 22 bp, Artificial Sequence
  Description of Artificial Sequence: Synthetic oligonucleotide
acgactctctagagagtcgtcc

SEQ ID NO: 8885 - DNA, 22 bp, Artificial Sequence
  Description of Artificial Sequence: Synthetic oligonucleotide
gagactctctagagagtctccc

SEQ ID NO: 8886 - DNA, 22 bp, Artificial Sequence
  Description of Artificial Sequence: Synthetic oligonucleotide
gcgactctctagagagtcgcca

SEQ ID NO: 8887 - DNA, 22 bp, Artificial Sequence
  Description of Artificial Sequence: Synthetic oligonucleotide
gcgactctctagagagtcgcac

SEQ ID NO: 8888 - DNA, 22 bp, Artificial Sequence
  Description of Artificial Sequence: Synthetic oligonucleotide
gtgactctctagagagtcaccc

SEQ ID NO: 8889 - DNA, 22 bp, Artificial Sequence
  Description of Artificial Sequence: Synthetic oligonucleotide
gggactctctagagagtcccgt

SEQ ID NO: 8890 - DNA, 22 bp, Artificial Sequence
  Description of Artificial Sequence: Synthetic oligonucleotide
gggactctctagagagtccctg

SEQ ID NO: 8891 - DNA, 22 bp, Artificial Sequence
  Description of Artificial Sequence: Synthetic oligonucleotide
aggactctctagagagtcctgg

SEQ ID NO: 8892 - DNA, 22 bp, Artificial Sequence
  Description of Artificial Sequence: Synthetic oligonucleotide
gagactctctagagagtctcgg

SEQ ID NO: 8893 - DNA, 22 bp, Artificial Sequence
  Description of Artificial Sequence: Synthetic oligonucleotide
gggactctctagagagtcccga

SEQ ID NO: 8894 - DNA, 22 bp, Artificial Sequence
  Description of Artificial Sequence: Synthetic oligonucleotide
gggactctctagagagtcccag

SEQ ID NO: 8895 - DNA, 22 bp, Artificial Sequence
  Description of Artificial Sequence: Synthetic oligonucleotide
tggactctctagagagtccagg

SEQ ID NO: 8896 - DNA, 22 bp, Artificial Sequence
  Description of Artificial Sequence: Synthetic oligonucleotide
gtgactctctagagagtcacgg

SEQ ID NO: 8897 - DNA, 22 bp, Artificial Sequence
  Description of Artificial Sequence: Synthetic oligonucleotide
gcgactctctagagagtcgccg

SEQ ID NO: 8898 - DNA, 22 bp, Artificial Sequence
  Description of Artificial Sequence: Synthetic oligonucleotide
gcgactctctagagagtcgctg

SEQ ID NO: 8899 - DNA, 22 bp, Artificial Sequence
  Description of Artificial Sequence: Synthetic oligonucleotide
acgactctctagagagtcgtcg

SEQ ID NO: 8900 - DNA, 22 bp, Artificial Sequence
  Description of Artificial Sequence: Synthetic oligonucleotide
gagactctctagagagtctccg

SEQ ID NO: 8901 - DNA, 22 bp, Artificial Sequence
  Description of Artificial Sequence: Synthetic oligonucleotide
gcgactctctagagagtcgcag

SEQ ID NO: 8902 - DNA, 22 bp, Artificial Sequence
  Description of Artificial Sequence: Synthetic oligonucleotide
gtgactctctagagagtcaccg

SEQ ID NO: 8903 - DNA, 22 bp, Artificial Sequence
  Description of Artificial Sequence: Synthetic oligonucleotide
cggactctctagagagtccgtg

SEQ ID NO: 8904 - DNA, 22 bp, Artificial Sequence
  Description of Artificial Sequence: Synthetic oligonucleotide
cagactctctagagagtctggg

SEQ ID NO: 8905 - DNA, 22 bp, Artificial Sequence
  Description of Artificial Sequence: Synthetic oligonucleotide
cggactctctagagagtccgag

SEQ ID NO: 8906 - DNA, 22 bp, Artificial Sequence
  Description of Artificial Sequence: Synthetic oligonucleotide
ctgactctctagagagtcaggg

SEQ ID NO: 8907 - DNA, 22 bp, Artificial Sequence
  Description of Artificial Sequence: Synthetic oligonucleotide
acgactctctagagagtcgtgg

SEQ ID NO: 8908 - DNA, 22 bp, Artificial Sequence
  Description of Artificial Sequence: Synthetic oligonucleotide
ccgactctctagagagtcggct

SEQ ID NO: 8909 - DNA, 22 bp, Artificial Sequence
  Description of Artificial Sequence: Synthetic oligonucleotide
ccgactctctagagagtcggca

SEQ ID NO: 8910 - DNA, 22 bp, Artificial Sequence
  Description of Artificial Sequence: Synthetic oligonucleotide
gagactctctagagagtctcgc

SEQ ID NO: 8911 - DNA, 22 bp, Artificial Sequence
  Description of Artificial Sequence: Synthetic oligonucleotide
gtgactctctagagagtcacgc

SEQ ID NO: 8912 - DNA, 22 bp, Artificial Sequence
  Description of Artificial Sequence: Synthetic oligonucleotide
aggactctctagagagtcctgc

SEQ ID NO: 8913 - DNA, 22 bp, Artificial Sequence
  Description of Artificial Sequence: Synthetic oligonucleotide
tggactctctagagagtccagc

SEQ ID NO: 8914 - DNA, 22 bp, Artificial Sequence
  Description of Artificial Sequence: Synthetic oligonucleotide
aggactctctagagagtcctcg

SEQ ID NO: 8915 - DNA, 22 bp, Artificial Sequence
  Description of Artificial Sequence: Synthetic oligonucleotide
tggactctctagagagtccacg

SEQ ID NO: 8916 - DNA, 22 bp, Artificial Sequence
  Description of Artificial Sequence: Synthetic oligonucleotide
ccgactctctagagagtcggtg

SEQ ID NO: 8917 - DNA, 22 bp, Artificial Sequence
  Description of Artificial Sequence: Synthetic oligonucleotide
ccgactctctagagagtcggag

SEQ ID NO: 8918 - DNA, 22 bp, Artificial Sequence
  Description of Artificial Sequence: Synthetic oligonucleotide
gggactctctagagagtcccgc

SEQ ID NO: 8919 - DNA, 22 bp, Artificial Sequence
  Description of Artificial Sequence: Synthetic oligonucleotide
gggactctctagagagtccctc

SEQ ID NO: 8920 - DNA, 22 bp, Artificial Sequence
  Description of Artificial Sequence: Synthetic oligonucleotide
gggactctctagagagtcccac

SEQ ID NO: 8921 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctcgcgagagtcnnnn

SEQ ID NO: 8922 - DNA, 22 bp, Artificial Sequence
  Description of Artificial Sequence: Synthetic oligonucleotide
cggactctcgcgagagtccgcc

SEQ ID NO: 8923 - DNA, 22 bp, Artificial Sequence
  Description of Artificial Sequence: Synthetic oligonucleotide
cggactctcgcgagagtccgct

SEQ ID NO: 8924 - DNA, 22 bp, Artificial Sequence
  Description of Artificial Sequence: Synthetic oligonucleotide
cggactctcgcgagagtccgtc

SEQ ID NO: 8925 - DNA, 22 bp, Artificial Sequence
  Description of Artificial Sequence: Synthetic oligonucleotide
aggactctcgcgagagtcctcc

SEQ ID NO: 8926 - DNA, 22 bp, Artificial Sequence
  Description of Artificial Sequence: Synthetic oligonucleotide
cagactctcgcgagagtctgcc

SEQ ID NO: 8927 - DNA, 22 bp, Artificial Sequence
  Description of Artificial Sequence: Synthetic oligonucleotide
cggactctcgcgagagtccgca

SEQ ID NO: 8928 - DNA, 22 bp, Artificial Sequence
  Description of Artificial Sequence: Synthetic oligonucleotide
cggactctcgcgagagtccgac

SEQ ID NO: 8929 - DNA, 22 bp, Artificial Sequence
  Description of Artificial Sequence: Synthetic oligonucleotide
tggactctcgcgagagtccacc

SEQ ID NO: 8930 - DNA, 22 bp, Artificial Sequence
  Description of Artificial Sequence: Synthetic oligonucleotide
ctgactctcgcgagagtcagcc

SEQ ID NO: 8931 - DNA, 22 bp, Artificial Sequence
  Description of Artificial Sequence: Synthetic oligonucleotide
ccgactctcgcgagagtcgggc

SEQ ID NO: 8932 - DNA, 22 bp, Artificial Sequence
  Description of Artificial Sequence: Synthetic oligonucleotide
ccgactctcgcgagagtcgggt

SEQ ID NO: 8933 - DNA, 22 bp, Artificial Sequence
  Description of Artificial Sequence: Synthetic oligonucleotide
ccgactctcgcgagagtcggtc

SEQ ID NO: 8934 - DNA, 22 bp, Artificial Sequence
  Description of Artificial Sequence: Synthetic oligonucleotide
acgactctcgcgagagtcgtgc

SEQ ID NO: 8935 - DNA, 22 bp, Artificial Sequence
  Description of Artificial Sequence: Synthetic oligonucleotide
cagactctcgcgagagtctggc

SEQ ID NO: 8936 - DNA, 22 bp, Artificial Sequence
  Description of Artificial Sequence: Synthetic oligonucleotide
ccgactctcgcgagagtcggga

SEQ ID NO: 8937 - DNA, 22 bp, Artificial Sequence
  Description of Artificial Sequence: Synthetic oligonucleotide
ccgactctcgcgagagtcggac

SEQ ID NO: 8938 - DNA, 22 bp, Artificial Sequence
  Description of Artificial Sequence: Synthetic oligonucleotide
ctgactctcgcgagagtcaggc

SEQ ID NO: 8939 - DNA, 22 bp, Artificial Sequence
  Description of Artificial Sequence: Synthetic oligonucleotide
gcgactctcgcgagagtcgccc

SEQ ID NO: 8940 - DNA, 22 bp, Artificial Sequence
  Description of Artificial Sequence: Synthetic oligonucleotide
gcgactctcgcgagagtcgcct

SEQ ID NO: 8941 - DNA, 22 bp, Artificial Sequence
  Description of Artificial Sequence: Synthetic oligonucleotide
gcgactctcgcgagagtcgctc

SEQ ID NO: 8942 - DNA, 22 bp, Artificial Sequence
  Description of Artificial Sequence: Synthetic oligonucleotide
acgactctcgcgagagtcgtcc

SEQ ID NO: 8943 - DNA, 22 bp, Artificial Sequence
  Description of Artificial Sequence: Synthetic oligonucleotide
gagactctcgcgagagtctccc

SEQ ID NO: 8944 - DNA, 22 bp, Artificial Sequence
  Description of Artificial Sequence: Synthetic oligonucleotide
gcgactctcgcgagagtcgcca

SEQ ID NO: 8945 - DNA, 22 bp, Artificial Sequence
  Description of Artificial Sequence: Synthetic oligonucleotide
gcgactctcgcgagagtcgcac

SEQ ID NO: 8946 - DNA, 22 bp, Artificial Sequence
  Description of Artificial Sequence: Synthetic oligonucleotide
gtgactctcgcgagagtcaccc

SEQ ID NO: 8947 - DNA, 22 bp, Artificial Sequence
  Description of Artificial Sequence: Synthetic oligonucleotide
gggactctcgcgagagtcccgt

SEQ ID NO: 8948 - DNA, 22 bp, Artificial Sequence
  Description of Artificial Sequence: Synthetic oligonucleotide
gggactctcgcgagagtccctg

SEQ ID NO: 8949 - DNA, 22 bp, Artificial Sequence
  Description of Artificial Sequence: Synthetic oligonucleotide
aggactctcgcgagagtcctgg

SEQ ID NO: 8950 - DNA, 22 bp, Artificial Sequence
  Description of Artificial Sequence: Synthetic oligonucleotide
gagactctcgcgagagtctcgg

SEQ ID NO: 8951 - DNA, 22 bp, Artificial Sequence
  Description of Artificial Sequence: Synthetic oligonucleotide
gggactctcgcgagagtcccga

SEQ ID NO: 8952 - DNA, 22 bp, Artificial Sequence
  Description of Artificial Sequence: Synthetic oligonucleotide
gggactctcgcgagagtcccag

SEQ ID NO: 8953 - DNA, 22 bp, Artificial Sequence
  Description of Artificial Sequence: Synthetic oligonucleotide
tggactctcgcgagagtccagg

SEQ ID NO: 8954 - DNA, 22 bp, Artificial Sequence
  Description of Artificial Sequence: Synthetic oligonucleotide
gtgactctcgcgagagtcacgg

SEQ ID NO: 8955 - DNA, 22 bp, Artificial Sequence
  Description of Artificial Sequence: Synthetic oligonucleotide
gcgactctcgcgagagtcgccg

SEQ ID NO: 8956 - DNA, 22 bp, Artificial Sequence
  Description of Artificial Sequence: Synthetic oligonucleotide
gcgactctcgcgagagtcgctg

SEQ ID NO: 8957 - DNA, 22 bp, Artificial Sequence
  Description of Artificial Sequence: Synthetic oligonucleotide
acgactctcgcgagagtcgtcg

SEQ ID NO: 8958 - DNA, 22 bp, Artificial Sequence
  Description of Artificial Sequence: Synthetic oligonucleotide
gagactctcgcgagagtctccg

SEQ ID NO: 8959 - DNA, 22 bp, Artificial Sequence
  Description of Artificial Sequence: Synthetic oligonucleotide
gcgactctcgcgagagtcgcag

SEQ ID NO: 8960 - DNA, 22 bp, Artificial Sequence
  Description of Artificial Sequence: Synthetic oligonucleotide
gtgactctcgcgagagtcaccg

SEQ ID NO: 8961 - DNA, 22 bp, Artificial Sequence
  Description of Artificial Sequence: Synthetic oligonucleotide
cggactctcgcgagagtccgtg

SEQ ID NO: 8962 - DNA, 22 bp, Artificial Sequence
  Description of Artificial Sequence: Synthetic oligonucleotide
cagactctcgcgagagtctggg

SEQ ID NO: 8963 - DNA, 22 bp, Artificial Sequence
  Description of Artificial Sequence: Synthetic oligonucleotide
cggactctcgcgagagtccgag

SEQ ID NO: 8964 - DNA, 22 bp, Artificial Sequence
  Description of Artificial Sequence: Synthetic oligonucleotide
ctgactctcgcgagagtcaggg

SEQ ID NO: 8965 - DNA, 22 bp, Artificial Sequence
  Description of Artificial Sequence: Synthetic oligonucleotide
acgactctcgcgagagtcgtgg

SEQ ID NO: 8966 - DNA, 22 bp, Artificial Sequence
  Description of Artificial Sequence: Synthetic oligonucleotide
ccgactctcgcgagagtcggct

SEQ ID NO: 8967 - DNA, 22 bp, Artificial Sequence
  Description of Artificial Sequence: Synthetic oligonucleotide
ccgactctcgcgagagtcggca

SEQ ID NO: 8968 - DNA, 22 bp, Artificial Sequence
  Description of Artificial Sequence: Synthetic oligonucleotide
gagactctcgcgagagtctcgc

SEQ ID NO: 8969 - DNA, 22 bp, Artificial Sequence
  Description of Artificial Sequence: Synthetic oligonucleotide
gtgactctcgcgagagtcacgc

SEQ ID NO: 8970 - DNA, 22 bp, Artificial Sequence
  Description of Artificial Sequence: Synthetic oligonucleotide
aggactctcgcgagagtcctgc

SEQ ID NO: 8971 - DNA, 22 bp, Artificial Sequence
  Description of Artificial Sequence: Synthetic oligonucleotide
tggactctcgcgagagtccagc

SEQ ID NO: 8972 - DNA, 22 bp, Artificial Sequence
  Description of Artificial Sequence: Synthetic oligonucleotide
aggactctcgcgagagtcctcg

SEQ ID NO: 8973 - DNA, 22 bp, Artificial Sequence
  Description of Artificial Sequence: Synthetic oligonucleotide
tggactctcgcgagagtccacg

SEQ ID NO: 8974 - DNA, 22 bp, Artificial Sequence
  Description of Artificial Sequence: Synthetic oligonucleotide
ccgactctcgcgagagtcggtg

SEQ ID NO: 8975 - DNA, 22 bp, Artificial Sequence
  Description of Artificial Sequence: Synthetic oligonucleotide
ccgactctcgcgagagtcggag

SEQ ID NO: 8976 - DNA, 22 bp, Artificial Sequence
  Description of Artificial Sequence: Synthetic oligonucleotide
gggactctcgcgagagtcccgc

SEQ ID NO: 8977 - DNA, 22 bp, Artificial Sequence
  Description of Artificial Sequence: Synthetic oligonucleotide
gggactctcgcgagagtccctc

SEQ ID NO: 8978 - DNA, 22 bp, Artificial Sequence
  Description of Artificial Sequence: Synthetic oligonucleotide
gggactctcgcgagagtcccac

SEQ ID NO: 8979 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctccggagagtcnnnn

SEQ ID NO: 8980 - DNA, 22 bp, Artificial Sequence
  Description of Artificial Sequence: Synthetic oligonucleotide
cggactctccggagagtccgcc

SEQ ID NO: 8981 - DNA, 22 bp, Artificial Sequence
  Description of Artificial Sequence: Synthetic oligonucleotide
cggactctccggagagtccgct

SEQ ID NO: 8982 - DNA, 22 bp, Artificial Sequence
  Description of Artificial Sequence: Synthetic oligonucleotide
cggactctccggagagtccgtc

SEQ ID NO: 8983 - DNA, 22 bp, Artificial Sequence
  Description of Artificial Sequence: Synthetic oligonucleotide
aggactctccggagagtcctcc

SEQ ID NO: 8984 - DNA, 22 bp, Artificial Sequence
  Description of Artificial Sequence: Synthetic oligonucleotide
cagactctccggagagtctgcc

SEQ ID NO: 8985 - DNA, 22 bp, Artificial Sequence
  Description of Artificial Sequence: Synthetic oligonucleotide
cggactctccggagagtccgca

SEQ ID NO: 8986 - DNA, 22 bp, Artificial Sequence
  Description of Artificial Sequence: Synthetic oligonucleotide
cggactctccggagagtccgac

SEQ ID NO: 8987 - DNA, 22 bp, Artificial Sequence
  Description of Artificial Sequence: Synthetic oligonucleotide
tggactctccggagagtccacc

SEQ ID NO: 8988 - DNA, 22 bp, Artificial Sequence
  Description of Artificial Sequence: Synthetic oligonucleotide
ctgactctccggagagtcagcc

SEQ ID NO: 8989 - DNA, 22 bp, Artificial Sequence
  Description of Artificial Sequence: Synthetic oligonucleotide
ccgactctccggagagtcgggc

SEQ ID NO: 8990 - DNA, 22 bp, Artificial Sequence
  Description of Artificial Sequence: Synthetic oligonucleotide
ccgactctccggagagtcgggt

SEQ ID NO: 8991 - DNA, 22 bp, Artificial Sequence
  Description of Artificial Sequence: Synthetic oligonucleotide
ccgactctccggagagtcggtc

SEQ ID NO: 8992 - DNA, 22 bp, Artificial Sequence
  Description of Artificial Sequence: Synthetic oligonucleotide
acgactctccggagagtcgtgc

SEQ ID NO: 8993 - DNA, 22 bp, Artificial Sequence
  Description of Artificial Sequence: Synthetic oligonucleotide
cagactctccggagagtctggc

SEQ ID NO: 8994 - DNA, 22 bp, Artificial Sequence
  Description of Artificial Sequence: Synthetic oligonucleotide
ccgactctccggagagtcggga

SEQ ID NO: 8995 - DNA, 22 bp, Artificial Sequence
  Description of Artificial Sequence: Synthetic oligonucleotide
ccgactctccggagagtcggac

SEQ ID NO: 8996 - DNA, 22 bp, Artificial Sequence
  Description of Artificial Sequence: Synthetic oligonucleotide
ctgactctccggagagtcaggc

SEQ ID NO: 8997 - DNA, 22 bp, Artificial Sequence
  Description of Artificial Sequence: Synthetic oligonucleotide
gcgactctccggagagtcgccc

SEQ ID NO: 8998 - DNA, 22 bp, Artificial Sequence
  Description of Artificial Sequence: Synthetic oligonucleotide
gcgactctccggagagtcgcct

SEQ ID NO: 8999 - DNA, 22 bp, Artificial Sequence
  Description of Artificial Sequence: Synthetic oligonucleotide
gcgactctccggagagtcgctc

SEQ ID NO: 9000 - DNA, 22 bp, Artificial Sequence
  Description of Artificial Sequence: Synthetic oligonucleotide
acgactctccggagagtcgtcc

SEQ ID NO: 9001 - DNA, 22 bp, Artificial Sequence
  Description of Artificial Sequence: Synthetic oligonucleotide
gagactctccggagagtctccc

SEQ ID NO: 9002 - DNA, 22 bp, Artificial Sequence
  Description of Artificial Sequence: Synthetic oligonucleotide
gcgactctccggagagtcgcca

SEQ ID NO: 9003 - DNA, 22 bp, Artificial Sequence
  Description of Artificial Sequence: Synthetic oligonucleotide
gcgactctccggagagtcgcac

SEQ ID NO: 9004 - DNA, 22 bp, Artificial Sequence
  Description of Artificial Sequence: Synthetic oligonucleotide
gtgactctccggagagtcaccc

SEQ ID NO: 9005 - DNA, 22 bp, Artificial Sequence
  Description of Artificial Sequence: Synthetic oligonucleotide
gggactctccggagagtcccgt

SEQ ID NO: 9006 - DNA, 22 bp, Artificial Sequence
  Description of Artificial Sequence: Synthetic oligonucleotide
gggactctccggagagtccctg

SEQ ID NO: 9007 - DNA, 22 bp, Artificial Sequence
  Description of Artificial Sequence: Synthetic oligonucleotide
aggactctccggagagtcctgg

SEQ ID NO: 9008 - DNA, 22 bp, Artificial Sequence
  Description of Artificial Sequence: Synthetic oligonucleotide
gagactctccggagagtctcgg

SEQ ID NO: 9009 - DNA, 22 bp, Artificial Sequence
  Description of Artificial Sequence: Synthetic oligonucleotide
gggactctccggagagtcccga

SEQ ID NO: 9010 - DNA, 22 bp, Artificial Sequence
  Description of Artificial Sequence: Synthetic oligonucleotide
gggactctccggagagtcccag

SEQ ID NO: 9011 - DNA, 22 bp, Artificial Sequence
  Description of Artificial Sequence: Synthetic oligonucleotide
tggactctccggagagtccagg

SEQ ID NO: 9012 - DNA, 22 bp, Artificial Sequence
  Description of Artificial Sequence: Synthetic oligonucleotide
gtgactctccggagagtcacgg

SEQ ID NO: 9013 - DNA, 22 bp, Artificial Sequence
  Description of Artificial Sequence: Synthetic oligonucleotide
gcgactctccggagagtcgccg

SEQ ID NO: 9014 - DNA, 22 bp, Artificial Sequence
  Description of Artificial Sequence: Synthetic oligonucleotide
gcgactctccggagagtcgctg

SEQ ID NO: 9015 - DNA, 22 bp, Artificial Sequence
  Description of Artificial Sequence: Synthetic oligonucleotide
acgactctccggagagtcgtcg

SEQ ID NO: 9016 - DNA, 22 bp, Artificial Sequence
  Description of Artificial Sequence: Synthetic oligonucleotide
gagactctccggagagtctccg

SEQ ID NO: 9017 - DNA, 22 bp, Artificial Sequence
  Description of Artificial Sequence: Synthetic oligonucleotide
gcgactctccggagagtcgcag

SEQ ID NO: 9018 - DNA, 22 bp, Artificial Sequence
  Description of Artificial Sequence: Synthetic oligonucleotide
gtgactctccggagagtcaccg

SEQ ID NO: 9019 - DNA, 22 bp, Artificial Sequence
  Description of Artificial Sequence: Synthetic oligonucleotide
cggactctccggagagtccgtg

SEQ ID NO: 9020 - DNA, 22 bp, Artificial Sequence
  Description of Artificial Sequence: Synthetic oligonucleotide
cagactctccggagagtctggg

SEQ ID NO: 9021 - DNA, 22 bp, Artificial Sequence
  Description of Artificial Sequence: Synthetic oligonucleotide
cggactctccggagagtccgag

SEQ ID NO: 9022 - DNA, 22 bp, Artificial Sequence
  Description of Artificial Sequence: Synthetic oligonucleotide
ctgactctccggagagtcaggg

SEQ ID NO: 9023 - DNA, 22 bp, Artificial Sequence
  Description of Artificial Sequence: Synthetic oligonucleotide
acgactctccggagagtcgtgg

SEQ ID NO: 9024 - DNA, 22 bp, Artificial Sequence
  Description of Artificial Sequence: Synthetic oligonucleotide
ccgactctccggagagtcggct

SEQ ID NO: 9025 - DNA, 22 bp, Artificial Sequence
  Description of Artificial Sequence: Synthetic oligonucleotide
ccgactctccggagagtcggca

SEQ ID NO: 9026 - DNA, 22 bp, Artificial Sequence
  Description of Artificial Sequence: Synthetic oligonucleotide
gagactctccggagagtctcgc

SEQ ID NO: 9027 - DNA, 22 bp, Artificial Sequence
  Description of Artificial Sequence: Synthetic oligonucleotide
gtgactctccggagagtcacgc

SEQ ID NO: 9028 - DNA, 22 bp, Artificial Sequence
  Description of Artificial Sequence: Synthetic oligonucleotide
aggactctccggagagtcctgc

SEQ ID NO: 9029 - DNA, 22 bp, Artificial Sequence
  Description of Artificial Sequence: Synthetic oligonucleotide
tggactctccggagagtccagc

SEQ ID NO: 9030 - DNA, 22 bp, Artificial Sequence
  Description of Artificial Sequence: Synthetic oligonucleotide
aggactctccggagagtcctcg

SEQ ID NO: 9031 - DNA, 22 bp, Artificial Sequence
  Description of Artificial Sequence: Synthetic oligonucleotide
tggactctccggagagtccacg

SEQ ID NO: 9032 - DNA, 22 bp, Artificial Sequence
  Description of Artificial Sequence: Synthetic oligonucleotide
ccgactctccggagagtcggtg

SEQ ID NO: 9033 - DNA, 22 bp, Artificial Sequence
  Description of Artificial Sequence: Synthetic oligonucleotide
ccgactctccggagagtcggag

SEQ ID NO: 9034 - DNA, 22 bp, Artificial Sequence
  Description of Artificial Sequence: Synthetic oligonucleotide
gggactctccggagagtcccgc

SEQ ID NO: 9035 - DNA, 22 bp, Artificial Sequence
  Description of Artificial Sequence: Synthetic oligonucleotide
gggactctccggagagtccctc

SEQ ID NO: 9036 - DNA, 22 bp, Artificial Sequence
  Description of Artificial Sequence: Synthetic oligonucleotide
gggactctccggagagtcccac

SEQ ID NO: 9037 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcagatctgagtcnnnn

SEQ ID NO: 9038 - DNA, 22 bp, Artificial Sequence
  Description of Artificial Sequence: Synthetic oligonucleotide
cggactcagatctgagtccgcc

SEQ ID NO: 9039 - DNA, 22 bp, Artificial Sequence
  Description of Artificial Sequence: Synthetic oligonucleotide
cggactcagatctgagtccgct

SEQ ID NO: 9040 - DNA, 22 bp, Artificial Sequence
  Description of Artificial Sequence: Synthetic oligonucleotide
cggactcagatctgagtccgtc

SEQ ID NO: 9041 - DNA, 22 bp, Artificial Sequence
  Description of Artificial Sequence: Synthetic oligonucleotide
aggactcagatctgagtcctcc

SEQ ID NO: 9042 - DNA, 22 bp, Artificial Sequence
  Description of Artificial Sequence: Synthetic oligonucleotide
cagactcagatctgagtctgcc

SEQ ID NO: 9043 - DNA, 22 bp, Artificial Sequence
  Description of Artificial Sequence: Synthetic oligonucleotide
cggactcagatctgagtccgca

SEQ ID NO: 9044 - DNA, 22 bp, Artificial Sequence
  Description of Artificial Sequence: Synthetic oligonucleotide
cggactcagatctgagtccgac

SEQ ID NO: 9045 - DNA, 22 bp, Artificial Sequence
  Description of Artificial Sequence: Synthetic oligonucleotide
tggactcagatctgagtccacc

SEQ ID NO: 9046 - DNA, 22 bp, Artificial Sequence
  Description of Artificial Sequence: Synthetic oligonucleotide
ctgactcagatctgagtcagcc

SEQ ID NO: 9047 - DNA, 22 bp, Artificial Sequence
  Description of Artificial Sequence: Synthetic oligonucleotide
ccgactcagatctgagtcgggc

SEQ ID NO: 9048 - DNA, 22 bp, Artificial Sequence
  Description of Artificial Sequence: Synthetic oligonucleotide
ccgactcagatctgagtcgggt

SEQ ID NO: 9049 - DNA, 22 bp, Artificial Sequence
  Description of Artificial Sequence: Synthetic oligonucleotide
ccgactcagatctgagtcggtc

SEQ ID NO: 9050 - DNA, 22 bp, Artificial Sequence
  Description of Artificial Sequence: Synthetic oligonucleotide
acgactcagatctgagtcgtgc

SEQ ID NO: 9051 - DNA, 22 bp, Artificial Sequence
  Description of Artificial Sequence: Synthetic oligonucleotide
cagactcagatctgagtctggc

SEQ ID NO: 9052 - DNA, 22 bp, Artificial Sequence
  Description of Artificial Sequence: Synthetic oligonucleotide
ccgactcagatctgagtcggga

SEQ ID NO: 9053 - DNA, 22 bp, Artificial Sequence
  Description of Artificial Sequence: Synthetic oligonucleotide
ccgactcagatctgagtcggac

SEQ ID NO: 9054 - DNA, 22 bp, Artificial Sequence
  Description of Artificial Sequence: Synthetic oligonucleotide
ctgactcagatctgagtcaggc

SEQ ID NO: 9055 - DNA, 22 bp, Artificial Sequence
  Description of Artificial Sequence: Synthetic oligonucleotide
gcgactcagatctgagtcgccc

SEQ ID NO: 9056 - DNA, 22 bp, Artificial Sequence
  Description of Artificial Sequence: Synthetic oligonucleotide
gcgactcagatctgagtcgcct

SEQ ID NO: 9057 - DNA, 22 bp, Artificial Sequence
  Description of Artificial Sequence: Synthetic oligonucleotide
gcgactcagatctgagtcgctc

SEQ ID NO: 9058 - DNA, 22 bp, Artificial Sequence
  Description of Artificial Sequence: Synthetic oligonucleotide
acgactcagatctgagtcgtcc

SEQ ID NO: 9059 - DNA, 22 bp, Artificial Sequence
  Description of Artificial Sequence: Synthetic oligonucleotide
gagactcagatctgagtctccc

SEQ ID NO: 9060 - DNA, 22 bp, Artificial Sequence
  Description of Artificial Sequence: Synthetic oligonucleotide
gcgactcagatctgagtcgcca

SEQ ID NO: 9061 - DNA, 22 bp, Artificial Sequence
  Description of Artificial Sequence: Synthetic oligonucleotide
gcgactcagatctgagtcgcac

SEQ ID NO: 9062 - DNA, 22 bp, Artificial Sequence
  Description of Artificial Sequence: Synthetic oligonucleotide
gtgactcagatctgagtcaccc

SEQ ID NO: 9063 - DNA, 22 bp, Artificial Sequence
  Description of Artificial Sequence: Synthetic oligonucleotide
gggactcagatctgagtcccgt

SEQ ID NO: 9064 - DNA, 22 bp, Artificial Sequence
  Description of Artificial Sequence: Synthetic oligonucleotide
gggactcagatctgagtccctg

SEQ ID NO: 9065 - DNA, 22 bp, Artificial Sequence
  Description of Artificial Sequence: Synthetic oligonucleotide
aggactcagatctgagtcctgg

SEQ ID NO: 9066 - DNA, 22 bp, Artificial Sequence
  Description of Artificial Sequence: Synthetic oligonucleotide
gagactcagatctgagtctcgg

SEQ ID NO: 9067 - DNA, 22 bp, Artificial Sequence
  Description of Artificial Sequence: Synthetic oligonucleotide
gggactcagatctgagtcccga

SEQ ID NO: 9068 - DNA, 22 bp, Artificial Sequence
  Description of Artificial Sequence: Synthetic oligonucleotide
gggactcagatctgagtcccag

SEQ ID NO: 9069 - DNA, 22 bp, Artificial Sequence
  Description of Artificial Sequence: Synthetic oligonucleotide
tggactcagatctgagtccagg

SEQ ID NO: 9070 - DNA, 22 bp, Artificial Sequence
  Description of Artificial Sequence: Synthetic oligonucleotide
gtgactcagatctgagtcacgg

SEQ ID NO: 9071 - DNA, 22 bp, Artificial Sequence
  Description of Artificial Sequence: Synthetic oligonucleotide
gcgactcagatctgagtcgccg

SEQ ID NO: 9072 - DNA, 22 bp, Artificial Sequence
  Description of Artificial Sequence: Synthetic oligonucleotide
gcgactcagatctgagtcgctg

SEQ ID NO: 9073 - DNA, 22 bp, Artificial Sequence
  Description of Artificial Sequence: Synthetic oligonucleotide
acgactcagatctgagtcgtcg

SEQ ID NO: 9074 - DNA, 22 bp, Artificial Sequence
  Description of Artificial Sequence: Synthetic oligonucleotide
gagactcagatctgagtctccg

SEQ ID NO: 9075 - DNA, 22 bp, Artificial Sequence
  Description of Artificial Sequence: Synthetic oligonucleotide
gcgactcagatctgagtcgcag

SEQ ID NO: 9076 - DNA, 22 bp, Artificial Sequence
  Description of Artificial Sequence: Synthetic oligonucleotide
gtgactcagatctgagtcaccg

SEQ ID NO: 9077 - DNA, 22 bp, Artificial Sequence
  Description of Artificial Sequence: Synthetic oligonucleotide
cggactcagatctgagtccgtg

SEQ ID NO: 9078 - DNA, 22 bp, Artificial Sequence
  Description of Artificial Sequence: Synthetic oligonucleotide
cagactcagatctgagtctggg

SEQ ID NO: 9079 - DNA, 22 bp, Artificial Sequence
  Description of Artificial Sequence: Synthetic oligonucleotide
cggactcagatctgagtccgag

SEQ ID NO: 9080 - DNA, 22 bp, Artificial Sequence
  Description of Artificial Sequence: Synthetic oligonucleotide
ctgactcagatctgagtcaggg

SEQ ID NO: 9081 - DNA, 22 bp, Artificial Sequence
  Description of Artificial Sequence: Synthetic oligonucleotide
acgactcagatctgagtcgtgg

SEQ ID NO: 9082 - DNA, 22 bp, Artificial Sequence
  Description of Artificial Sequence: Synthetic oligonucleotide
ccgactcagatctgagtcggct

SEQ ID NO: 9083 - DNA, 22 bp, Artificial Sequence
  Description of Artificial Sequence: Synthetic oligonucleotide
ccgactcagatctgagtcggca

SEQ ID NO: 9084 - DNA, 22 bp, Artificial Sequence
  Description of Artificial Sequence: Synthetic oligonucleotide
gagactcagatctgagtctcgc

SEQ ID NO: 9085 - DNA, 22 bp, Artificial Sequence
  Description of Artificial Sequence: Synthetic oligonucleotide
gtgactcagatctgagtcacgc

SEQ ID NO: 9086 - DNA, 22 bp, Artificial Sequence
  Description of Artificial Sequence: Synthetic oligonucleotide
aggactcagatctgagtcctgc

SEQ ID NO: 9087 - DNA, 22 bp, Artificial Sequence
  Description of Artificial Sequence: Synthetic oligonucleotide
tggactcagatctgagtccagc

SEQ ID NO: 9088 - DNA, 22 bp, Artificial Sequence
  Description of Artificial Sequence: Synthetic oligonucleotide
aggactcagatctgagtcctcg

SEQ ID NO: 9089 - DNA, 22 bp, Artificial Sequence
  Description of Artificial Sequence: Synthetic oligonucleotide
tggactcagatctgagtccacg

SEQ ID NO: 9090 - DNA, 22 bp, Artificial Sequence
  Description of Artificial Sequence: Synthetic oligonucleotide
ccgactcagatctgagtcggtg

SEQ ID NO: 9091 - DNA, 22 bp, Artificial Sequence
  Description of Artificial Sequence: Synthetic oligonucleotide
ccgactcagatctgagtcggag

SEQ ID NO: 9092 - DNA, 22 bp, Artificial Sequence
  Description of Artificial Sequence: Synthetic oligonucleotide
gggactcagatctgagtcccgc

SEQ ID NO: 9093 - DNA, 22 bp, Artificial Sequence
  Description of Artificial Sequence: Synthetic oligonucleotide
gggactcagatctgagtccctc

SEQ ID NO: 9094 - DNA, 22 bp, Artificial Sequence
  Description of Artificial Sequence: Synthetic oligonucleotide
gggactcagatctgagtcccac

SEQ ID NO: 9095 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcagtactgagtcnnnn

SEQ ID NO: 9096 - DNA, 22 bp, Artificial Sequence
  Description of Artificial Sequence: Synthetic oligonucleotide
cggactcagtactgagtccgcc

SEQ ID NO: 9097 - DNA, 22 bp, Artificial Sequence
  Description of Artificial Sequence: Synthetic oligonucleotide
cggactcagtactgagtccgct

SEQ ID NO: 9098 - DNA, 22 bp, Artificial Sequence
  Description of Artificial Sequence: Synthetic oligonucleotide
cggactcagtactgagtccgtc

SEQ ID NO: 9099 - DNA, 22 bp, Artificial Sequence
  Description of Artificial Sequence: Synthetic oligonucleotide
aggactcagtactgagtcctcc

SEQ ID NO: 9100 - DNA, 22 bp, Artificial Sequence
  Description of Artificial Sequence: Synthetic oligonucleotide
cagactcagtactgagtctgcc

SEQ ID NO: 9101 - DNA, 22 bp, Artificial Sequence
  Description of Artificial Sequence: Synthetic oligonucleotide
cggactcagtactgagtccgca

SEQ ID NO: 9102 - DNA, 22 bp, Artificial Sequence
  Description of Artificial Sequence: Synthetic oligonucleotide
cggactcagtactgagtccgac

SEQ ID NO: 9103 - DNA, 22 bp, Artificial Sequence
  Description of Artificial Sequence: Synthetic oligonucleotide
tggactcagtactgagtccacc

SEQ ID NO: 9104 - DNA, 22 bp, Artificial Sequence
  Description of Artificial Sequence: Synthetic oligonucleotide
ctgactcagtactgagtcagcc

SEQ ID NO: 9105 - DNA, 22 bp, Artificial Sequence
  Description of Artificial Sequence: Synthetic oligonucleotide
ccgactcagtactgagtcgggc

SEQ ID NO: 9106 - DNA, 22 bp, Artificial Sequence
  Description of Artificial Sequence: Synthetic oligonucleotide
ccgactcagtactgagtcgggt

SEQ ID NO: 9107 - DNA, 22 bp, Artificial Sequence
  Description of Artificial Sequence: Synthetic oligonucleotide
ccgactcagtactgagtcggtc

SEQ ID NO: 9108 - DNA, 22 bp, Artificial Sequence
  Description of Artificial Sequence: Synthetic oligonucleotide
acgactcagtactgagtcgtgc

SEQ ID NO: 9109 - DNA, 22 bp, Artificial Sequence
  Description of Artificial Sequence: Synthetic oligonucleotide
cagactcagtactgagtctggc

SEQ ID NO: 9110 - DNA, 22 bp, Artificial Sequence
  Description of Artificial Sequence: Synthetic oligonucleotide
ccgactcagtactgagtcggga

SEQ ID NO: 9111 - DNA, 22 bp, Artificial Sequence
  Description of Artificial Sequence: Synthetic oligonucleotide
ccgactcagtactgagtcggac

SEQ ID NO: 9112 - DNA, 22 bp, Artificial Sequence
  Description of Artificial Sequence: Synthetic oligonucleotide
ctgactcagtactgagtcaggc

SEQ ID NO: 9113 - DNA, 22 bp, Artificial Sequence
  Description of Artificial Sequence: Synthetic oligonucleotide
gcgactcagtactgagtcgccc

SEQ ID NO: 9114 - DNA, 22 bp, Artificial Sequence
  Description of Artificial Sequence: Synthetic oligonucleotide
gcgactcagtactgagtcgcct

SEQ ID NO: 9115 - DNA, 22 bp, Artificial Sequence
  Description of Artificial Sequence: Synthetic oligonucleotide
gcgactcagtactgagtcgctc

SEQ ID NO: 9116 - DNA, 22 bp, Artificial Sequence
  Description of Artificial Sequence: Synthetic oligonucleotide
acgactcagtactgagtcgtcc

SEQ ID NO: 9117 - DNA, 22 bp, Artificial Sequence
  Description of Artificial Sequence: Synthetic oligonucleotide
gagactcagtactgagtctccc

SEQ ID NO: 9118 - DNA, 22 bp, Artificial Sequence
  Description of Artificial Sequence: Synthetic oligonucleotide
gcgactcagtactgagtcgcca

SEQ ID NO: 9119 - DNA, 22 bp, Artificial Sequence
  Description of Artificial Sequence: Synthetic oligonucleotide
gcgactcagtactgagtcgcac

SEQ ID NO: 9120 - DNA, 22 bp, Artificial Sequence
  Description of Artificial Sequence: Synthetic oligonucleotide
gtgactcagtactgagtcaccc

SEQ ID NO: 9121 - DNA, 22 bp, Artificial Sequence
  Description of Artificial Sequence: Synthetic oligonucleotide
gggactcagtactgagtcccgt

SEQ ID NO: 9122 - DNA, 22 bp, Artificial Sequence
  Description of Artificial Sequence: Synthetic oligonucleotide
gggactcagtactgagtccctg

SEQ ID NO: 9123 - DNA, 22 bp, Artificial Sequence
  Description of Artificial Sequence: Synthetic oligonucleotide
aggactcagtactgagtcctgg

SEQ ID NO: 9124 - DNA, 22 bp, Artificial Sequence
  Description of Artificial Sequence: Synthetic oligonucleotide
gagactcagtactgagtctcgg

SEQ ID NO: 9125 - DNA, 22 bp, Artificial Sequence
  Description of Artificial Sequence: Synthetic oligonucleotide
gggactcagtactgagtcccga

SEQ ID NO: 9126 - DNA, 22 bp, Artificial Sequence
  Description of Artificial Sequence: Synthetic oligonucleotide
gggactcagtactgagtcccag

SEQ ID NO: 9127 - DNA, 22 bp, Artificial Sequence
  Description of Artificial Sequence: Synthetic oligonucleotide
tggactcagtactgagtccagg

SEQ ID NO: 9128 - DNA, 22 bp, Artificial Sequence
  Description of Artificial Sequence: Synthetic oligonucleotide
gtgactcagtactgagtcacgg

SEQ ID NO: 9129 - DNA, 22 bp, Artificial Sequence
  Description of Artificial Sequence: Synthetic oligonucleotide
gcgactcagtactgagtcgccg

SEQ ID NO: 9130 - DNA, 22 bp, Artificial Sequence
  Description of Artificial Sequence: Synthetic oligonucleotide
gcgactcagtactgagtcgctg

SEQ ID NO: 9131 - DNA, 22 bp, Artificial Sequence
  Description of Artificial Sequence: Synthetic oligonucleotide
acgactcagtactgagtcgtcg

SEQ ID NO: 9132 - DNA, 22 bp, Artificial Sequence
  Description of Artificial Sequence: Synthetic oligonucleotide
gagactcagtactgagtctccg

SEQ ID NO: 9133 - DNA, 22 bp, Artificial Sequence
  Description of Artificial Sequence: Synthetic oligonucleotide
gcgactcagtactgagtcgcag

SEQ ID NO: 9134 - DNA, 22 bp, Artificial Sequence
  Description of Artificial Sequence: Synthetic oligonucleotide
gtgactcagtactgagtcaccg

SEQ ID NO: 9135 - DNA, 22 bp, Artificial Sequence
  Description of Artificial Sequence: Synthetic oligonucleotide
cggactcagtactgagtccgtg

SEQ ID NO: 9136 - DNA, 22 bp, Artificial Sequence
  Description of Artificial Sequence: Synthetic oligonucleotide
cagactcagtactgagtctggg

SEQ ID NO: 9137 - DNA, 22 bp, Artificial Sequence
  Description of Artificial Sequence: Synthetic oligonucleotide
cggactcagtactgagtccgag

SEQ ID NO: 9138 - DNA, 22 bp, Artificial Sequence
  Description of Artificial Sequence: Synthetic oligonucleotide
ctgactcagtactgagtcaggg

SEQ ID NO: 9139 - DNA, 22 bp, Artificial Sequence
  Description of Artificial Sequence: Synthetic oligonucleotide
acgactcagtactgagtcgtgg

SEQ ID NO: 9140 - DNA, 22 bp, Artificial Sequence
  Description of Artificial Sequence: Synthetic oligonucleotide
ccgactcagtactgagtcggct

SEQ ID NO: 9141 - DNA, 22 bp, Artificial Sequence
  Description of Artificial Sequence: Synthetic oligonucleotide
ccgactcagtactgagtcggca

SEQ ID NO: 9142 - DNA, 22 bp, Artificial Sequence
  Description of Artificial Sequence: Synthetic oligonucleotide
gagactcagtactgagtctcgc

SEQ ID NO: 9143 - DNA, 22 bp, Artificial Sequence
  Description of Artificial Sequence: Synthetic oligonucleotide
gtgactcagtactgagtcacgc

SEQ ID NO: 9144 - DNA, 22 bp, Artificial Sequence
  Description of Artificial Sequence: Synthetic oligonucleotide
aggactcagtactgagtcctgc

SEQ ID NO: 9145 - DNA, 22 bp, Artificial Sequence
  Description of Artificial Sequence: Synthetic oligonucleotide
tggactcagtactgagtccagc

SEQ ID NO: 9146 - DNA, 22 bp, Artificial Sequence
  Description of Artificial Sequence: Synthetic oligonucleotide
aggactcagtactgagtcctcg

SEQ ID NO: 9147 - DNA, 22 bp, Artificial Sequence
  Description of Artificial Sequence: Synthetic oligonucleotide
tggactcagtactgagtccacg

SEQ ID NO: 9148 - DNA, 22 bp, Artificial Sequence
  Description of Artificial Sequence: Synthetic oligonucleotide
ccgactcagtactgagtcggtg

SEQ ID NO: 9149 - DNA, 22 bp, Artificial Sequence
  Description of Artificial Sequence: Synthetic oligonucleotide
ccgactcagtactgagtcggag

SEQ ID NO: 9150 - DNA, 22 bp, Artificial Sequence
  Description of Artificial Sequence: Synthetic oligonucleotide
gggactcagtactgagtcccgc

SEQ ID NO: 9151 - DNA, 22 bp, Artificial Sequence
  Description of Artificial Sequence: Synthetic oligonucleotide
gggactcagtactgagtccctc

SEQ ID NO: 9152 - DNA, 22 bp, Artificial Sequence
  Description of Artificial Sequence: Synthetic oligonucleotide
gggactcagtactgagtcccac

SEQ ID NO: 9153 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaggcctgagtcnnnn

SEQ ID NO: 9154 - DNA, 22 bp, Artificial Sequence
  Description of Artificial Sequence: Synthetic oligonucleotide
cggactcaggcctgagtccgcc

SEQ ID NO: 9155 - DNA, 22 bp, Artificial Sequence
  Description of Artificial Sequence: Synthetic oligonucleotide
cggactcaggcctgagtccgct

SEQ ID NO: 9156 - DNA, 22 bp, Artificial Sequence
  Description of Artificial Sequence: Synthetic oligonucleotide
cggactcaggcctgagtccgtc

SEQ ID NO: 9157 - DNA, 22 bp, Artificial Sequence
  Description of Artificial Sequence: Synthetic oligonucleotide
aggactcaggcctgagtcctcc

SEQ ID NO: 9158 - DNA, 22 bp, Artificial Sequence
  Description of Artificial Sequence: Synthetic oligonucleotide
cagactcaggcctgagtctgcc

SEQ ID NO: 9159 - DNA, 22 bp, Artificial Sequence
  Description of Artificial Sequence: Synthetic oligonucleotide
cggactcaggcctgagtccgca

SEQ ID NO: 9160 - DNA, 22 bp, Artificial Sequence
  Description of Artificial Sequence: Synthetic oligonucleotide
cggactcaggcctgagtccgac

SEQ ID NO: 9161 - DNA, 22 bp, Artificial Sequence
  Description of Artificial Sequence: Synthetic oligonucleotide
tggactcaggcctgagtccacc

SEQ ID NO: 9162 - DNA, 22 bp, Artificial Sequence
  Description of Artificial Sequence: Synthetic oligonucleotide
ctgactcaggcctgagtcagcc

SEQ ID NO: 9163 - DNA, 22 bp, Artificial Sequence
  Description of Artificial Sequence: Synthetic oligonucleotide
ccgactcaggcctgagtcgggc

SEQ ID NO: 9164 - DNA, 22 bp, Artificial Sequence
  Description of Artificial Sequence: Synthetic oligonucleotide
ccgactcaggcctgagtcgggt

SEQ ID NO: 9165 - DNA, 22 bp, Artificial Sequence
  Description of Artificial Sequence: Synthetic oligonucleotide
ccgactcaggcctgagtcggtc

SEQ ID NO: 9166 - DNA, 22 bp, Artificial Sequence
  Description of Artificial Sequence: Synthetic oligonucleotide
acgactcaggcctgagtcgtgc

SEQ ID NO: 9167 - DNA, 22 bp, Artificial Sequence
  Description of Artificial Sequence: Synthetic oligonucleotide
cagactcaggcctgagtctggc

SEQ ID NO: 9168 - DNA, 22 bp, Artificial Sequence
  Description of Artificial Sequence: Synthetic oligonucleotide
ccgactcaggcctgagtcggga

SEQ ID NO: 9169 - DNA, 22 bp, Artificial Sequence
  Description of Artificial Sequence: Synthetic oligonucleotide
ccgactcaggcctgagtcggac

SEQ ID NO: 9170 - DNA, 22 bp, Artificial Sequence
  Description of Artificial Sequence: Synthetic oligonucleotide
ctgactcaggcctgagtcaggc

SEQ ID NO: 9171 - DNA, 22 bp, Artificial Sequence
  Description of Artificial Sequence: Synthetic oligonucleotide
gcgactcaggcctgagtcgccc

SEQ ID NO: 9172 - DNA, 22 bp, Artificial Sequence
  Description of Artificial Sequence: Synthetic oligonucleotide
gcgactcaggcctgagtcgcct

SEQ ID NO: 9173 - DNA, 22 bp, Artificial Sequence
  Description of Artificial Sequence: Synthetic oligonucleotide
gcgactcaggcctgagtcgctc

SEQ ID NO: 9174 - DNA, 22 bp, Artificial Sequence
  Description of Artificial Sequence: Synthetic oligonucleotide
acgactcaggcctgagtcgtcc

SEQ ID NO: 9175 - DNA, 22 bp, Artificial Sequence
  Description of Artificial Sequence: Synthetic oligonucleotide
gagactcaggcctgagtctccc

SEQ ID NO: 9176 - DNA, 22 bp, Artificial Sequence
  Description of Artificial Sequence: Synthetic oligonucleotide
gcgactcaggcctgagtcgcca

SEQ ID NO: 9177 - DNA, 22 bp, Artificial Sequence
  Description of Artificial Sequence: Synthetic oligonucleotide
gcgactcaggcctgagtcgcac

SEQ ID NO: 9178 - DNA, 22 bp, Artificial Sequence
  Description of Artificial Sequence: Synthetic oligonucleotide
gtgactcaggcctgagtcaccc

SEQ ID NO: 9179 - DNA, 22 bp, Artificial Sequence
  Description of Artificial Sequence: Synthetic oligonucleotide
gggactcaggcctgagtcccgt

SEQ ID NO: 9180 - DNA, 22 bp, Artificial Sequence
  Description of Artificial Sequence: Synthetic oligonucleotide
gggactcaggcctgagtccctg

SEQ ID NO: 9181 - DNA, 22 bp, Artificial Sequence
  Description of Artificial Sequence: Synthetic oligonucleotide
aggactcaggcctgagtcctgg

SEQ ID NO: 9182 - DNA, 22 bp, Artificial Sequence
  Description of Artificial Sequence: Synthetic oligonucleotide
gagactcaggcctgagtctcgg

SEQ ID NO: 9183 - DNA, 22 bp, Artificial Sequence
  Description of Artificial Sequence: Synthetic oligonucleotide
gggactcaggcctgagtcccga

SEQ ID NO: 9184 - DNA, 22 bp, Artificial Sequence
  Description of Artificial Sequence: Synthetic oligonucleotide
gggactcaggcctgagtcccag

SEQ ID NO: 9185 - DNA, 22 bp, Artificial Sequence
  Description of Artificial Sequence: Synthetic oligonucleotide
tggactcaggcctgagtccagg

SEQ ID NO: 9186 - DNA, 22 bp, Artificial Sequence
  Description of Artificial Sequence: Synthetic oligonucleotide
gtgactcaggcctgagtcacgg

SEQ ID NO: 9187 - DNA, 22 bp, Artificial Sequence
  Description of Artificial Sequence: Synthetic oligonucleotide
gcgactcaggcctgagtcgccg

SEQ ID NO: 9188 - DNA, 22 bp, Artificial Sequence
  Description of Artificial Sequence: Synthetic oligonucleotide
gcgactcaggcctgagtcgctg

SEQ ID NO: 9189 - DNA, 22 bp, Artificial Sequence
  Description of Artificial Sequence: Synthetic oligonucleotide
acgactcaggcctgagtcgtcg

SEQ ID NO: 9190 - DNA, 22 bp, Artificial Sequence
  Description of Artificial Sequence: Synthetic oligonucleotide
gagactcaggcctgagtctccg

SEQ ID NO: 9191 - DNA, 22 bp, Artificial Sequence
  Description of Artificial Sequence: Synthetic oligonucleotide
gcgactcaggcctgagtcgcag

SEQ ID NO: 9192 - DNA, 22 bp, Artificial Sequence
  Description of Artificial Sequence: Synthetic oligonucleotide
gtgactcaggcctgagtcaccg

SEQ ID NO: 9193 - DNA, 22 bp, Artificial Sequence
  Description of Artificial Sequence: Synthetic oligonucleotide
cggactcaggcctgagtccgtg

SEQ ID NO: 9194 - DNA, 22 bp, Artificial Sequence
  Description of Artificial Sequence: Synthetic oligonucleotide
cagactcaggcctgagtctggg

SEQ ID NO: 9195 - DNA, 22 bp, Artificial Sequence
  Description of Artificial Sequence: Synthetic oligonucleotide
cggactcaggcctgagtccgag

SEQ ID NO: 9196 - DNA, 22 bp, Artificial Sequence
  Description of Artificial Sequence: Synthetic oligonucleotide
ctgactcaggcctgagtcaggg

SEQ ID NO: 9197 - DNA, 22 bp, Artificial Sequence
  Description of Artificial Sequence: Synthetic oligonucleotide
acgactcaggcctgagtcgtgg

SEQ ID NO: 9198 - DNA, 22 bp, Artificial Sequence
  Description of Artificial Sequence: Synthetic oligonucleotide
ccgactcaggcctgagtcggct

SEQ ID NO: 9199 - DNA, 22 bp, Artificial Sequence
  Description of Artificial Sequence: Synthetic oligonucleotide
ccgactcaggcctgagtcggca

SEQ ID NO: 9200 - DNA, 22 bp, Artificial Sequence
  Description of Artificial Sequence: Synthetic oligonucleotide
gagactcaggcctgagtctcgc

SEQ ID NO: 9201 - DNA, 22 bp, Artificial Sequence
  Description of Artificial Sequence: Synthetic oligonucleotide
gtgactcaggcctgagtcacgc

SEQ ID NO: 9202 - DNA, 22 bp, Artificial Sequence
  Description of Artificial Sequence: Synthetic oligonucleotide
aggactcaggcctgagtcctgc

SEQ ID NO: 9203 - DNA, 22 bp, Artificial Sequence
  Description of Artificial Sequence: Synthetic oligonucleotide
tggactcaggcctgagtccagc

SEQ ID NO: 9204 - DNA, 22 bp, Artificial Sequence
  Description of Artificial Sequence: Synthetic oligonucleotide
aggactcaggcctgagtcctcg

SEQ ID NO: 9205 - DNA, 22 bp, Artificial Sequence
  Description of Artificial Sequence: Synthetic oligonucleotide
tggactcaggcctgagtccacg

SEQ ID NO: 9206 - DNA, 22 bp, Artificial Sequence
  Description of Artificial Sequence: Synthetic oligonucleotide
ccgactcaggcctgagtcggtg

SEQ ID NO: 9207 - DNA, 22 bp, Artificial Sequence
  Description of Artificial Sequence: Synthetic oligonucleotide
ccgactcaggcctgagtcggag

SEQ ID NO: 9208 - DNA, 22 bp, Artificial Sequence
  Description of Artificial Sequence: Synthetic oligonucleotide
gggactcaggcctgagtcccgc

SEQ ID NO: 9209 - DNA, 22 bp, Artificial Sequence
  Description of Artificial Sequence: Synthetic oligonucleotide
gggactcaggcctgagtccctc

SEQ ID NO: 9210 - DNA, 22 bp, Artificial Sequence
  Description of Artificial Sequence: Synthetic oligonucleotide
gggactcaggcctgagtcccac

SEQ ID NO: 9211 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcagcgctgagtcnnnn

SEQ ID NO: 9212 - DNA, 22 bp, Artificial Sequence
  Description of Artificial Sequence: Synthetic oligonucleotide
cggactcagcgctgagtccgcc

SEQ ID NO: 9213 - DNA, 22 bp, Artificial Sequence
  Description of Artificial Sequence: Synthetic oligonucleotide
cggactcagcgctgagtccgct

SEQ ID NO: 9214 - DNA, 22 bp, Artificial Sequence
  Description of Artificial Sequence: Synthetic oligonucleotide
cggactcagcgctgagtccgtc

SEQ ID NO: 9215 - DNA, 22 bp, Artificial Sequence
  Description of Artificial Sequence: Synthetic oligonucleotide
aggactcagcgctgagtcctcc

SEQ ID NO: 9216 - DNA, 22 bp, Artificial Sequence
  Description of Artificial Sequence: Synthetic oligonucleotide
cagactcagcgctgagtctgcc

SEQ ID NO: 9217 - DNA, 22 bp, Artificial Sequence
  Description of Artificial Sequence: Synthetic oligonucleotide
cggactcagcgctgagtccgca

SEQ ID NO: 9218 - DNA, 22 bp, Artificial Sequence
  Description of Artificial Sequence: Synthetic oligonucleotide
cggactcagcgctgagtccgac

SEQ ID NO: 9219 - DNA, 22 bp, Artificial Sequence
  Description of Artificial Sequence: Synthetic oligonucleotide
tggactcagcgctgagtccacc

SEQ ID NO: 9220 - DNA, 22 bp, Artificial Sequence
  Description of Artificial Sequence: Synthetic oligonucleotide
ctgactcagcgctgagtcagcc

SEQ ID NO: 9221 - DNA, 22 bp, Artificial Sequence
  Description of Artificial Sequence: Synthetic oligonucleotide
ccgactcagcgctgagtcgggc

SEQ ID NO: 9222 - DNA, 22 bp, Artificial Sequence
  Description of Artificial Sequence: Synthetic oligonucleotide
ccgactcagcgctgagtcgggt

SEQ ID NO: 9223 - DNA, 22 bp, Artificial Sequence
  Description of Artificial Sequence: Synthetic oligonucleotide
ccgactcagcgctgagtcggtc

SEQ ID NO: 9224 - DNA, 22 bp, Artificial Sequence
  Description of Artificial Sequence: Synthetic oligonucleotide
acgactcagcgctgagtcgtgc

SEQ ID NO: 9225 - DNA, 22 bp, Artificial Sequence
  Description of Artificial Sequence: Synthetic oligonucleotide
cagactcagcgctgagtctggc

SEQ ID NO: 9226 - DNA, 22 bp, Artificial Sequence
  Description of Artificial Sequence: Synthetic oligonucleotide
ccgactcagcgctgagtcggga

SEQ ID NO: 9227 - DNA, 22 bp, Artificial Sequence
  Description of Artificial Sequence: Synthetic oligonucleotide
ccgactcagcgctgagtcggac

SEQ ID NO: 9228 - DNA, 22 bp, Artificial Sequence
  Description of Artificial Sequence: Synthetic oligonucleotide
ctgactcagcgctgagtcaggc

SEQ ID NO: 9229 - DNA, 22 bp, Artificial Sequence
  Description of Artificial Sequence: Synthetic oligonucleotide
gcgactcagcgctgagtcgccc

SEQ ID NO: 9230 - DNA, 22 bp, Artificial Sequence
  Description of Artificial Sequence: Synthetic oligonucleotide
gcgactcagcgctgagtcgcct

SEQ ID NO: 9231 - DNA, 22 bp, Artificial Sequence
  Description of Artificial Sequence: Synthetic oligonucleotide
gcgactcagcgctgagtcgctc

SEQ ID NO: 9232 - DNA, 22 bp, Artificial Sequence
  Description of Artificial Sequence: Synthetic oligonucleotide
acgactcagcgctgagtcgtcc

SEQ ID NO: 9233 - DNA, 22 bp, Artificial Sequence
  Description of Artificial Sequence: Synthetic oligonucleotide
gagactcagcgctgagtctccc

SEQ ID NO: 9234 - DNA, 22 bp, Artificial Sequence
  Description of Artificial Sequence: Synthetic oligonucleotide
gcgactcagcgctgagtcgcca

SEQ ID NO: 9235 - DNA, 22 bp, Artificial Sequence
  Description of Artificial Sequence: Synthetic oligonucleotide
gcgactcagcgctgagtcgcac

SEQ ID NO: 9236 - DNA, 22 bp, Artificial Sequence
  Description of Artificial Sequence: Synthetic oligonucleotide
gtgactcagcgctgagtcaccc

SEQ ID NO: 9237 - DNA, 22 bp, Artificial Sequence
  Description of Artificial Sequence: Synthetic oligonucleotide
gggactcagcgctgagtcccgt

SEQ ID NO: 9238 - DNA, 22 bp, Artificial Sequence
  Description of Artificial Sequence: Synthetic oligonucleotide
gggactcagcgctgagtccctg

SEQ ID NO: 9239 - DNA, 22 bp, Artificial Sequence
  Description of Artificial Sequence: Synthetic oligonucleotide
aggactcagcgctgagtcctgg

SEQ ID NO: 9240 - DNA, 22 bp, Artificial Sequence
  Description of Artificial Sequence: Synthetic oligonucleotide
gagactcagcgctgagtctcgg

SEQ ID NO: 9241 - DNA, 22 bp, Artificial Sequence
  Description of Artificial Sequence: Synthetic oligonucleotide
gggactcagcgctgagtcccga

SEQ ID NO: 9242 - DNA, 22 bp, Artificial Sequence
  Description of Artificial Sequence: Synthetic oligonucleotide
gggactcagcgctgagtcccag

SEQ ID NO: 9243 - DNA, 22 bp, Artificial Sequence
  Description of Artificial Sequence: Synthetic oligonucleotide
tggactcagcgctgagtccagg

SEQ ID NO: 9244 - DNA, 22 bp, Artificial Sequence
  Description of Artificial Sequence: Synthetic oligonucleotide
gtgactcagcgctgagtcacgg

SEQ ID NO: 9245 - DNA, 22 bp, Artificial Sequence
  Description of Artificial Sequence: Synthetic oligonucleotide
gcgactcagcgctgagtcgccg

SEQ ID NO: 9246 - DNA, 22 bp, Artificial Sequence
  Description of Artificial Sequence: Synthetic oligonucleotide
gcgactcagcgctgagtcgctg

SEQ ID NO: 9247 - DNA, 22 bp, Artificial Sequence
  Description of Artificial Sequence: Synthetic oligonucleotide
acgactcagcgctgagtcgtcg

SEQ ID NO: 9248 - DNA, 22 bp, Artificial Sequence
  Description of Artificial Sequence: Synthetic oligonucleotide
gagactcagcgctgagtctccg

SEQ ID NO: 9249 - DNA, 22 bp, Artificial Sequence
  Description of Artificial Sequence: Synthetic oligonucleotide
gcgactcagcgctgagtcgcag

SEQ ID NO: 9250 - DNA, 22 bp, Artificial Sequence
  Description of Artificial Sequence: Synthetic oligonucleotide
gtgactcagcgctgagtcaccg

SEQ ID NO: 9251 - DNA, 22 bp, Artificial Sequence
  Description of Artificial Sequence: Synthetic oligonucleotide
cggactcagcgctgagtccgtg

SEQ ID NO: 9252 - DNA, 22 bp, Artificial Sequence
  Description of Artificial Sequence: Synthetic oligonucleotide
cagactcagcgctgagtctggg

SEQ ID NO: 9253 - DNA, 22 bp, Artificial Sequence
  Description of Artificial Sequence: Synthetic oligonucleotide
cggactcagcgctgagtccgag

SEQ ID NO: 9254 - DNA, 22 bp, Artificial Sequence
  Description of Artificial Sequence: Synthetic oligonucleotide
ctgactcagcgctgagtcaggg

SEQ ID NO: 9255 - DNA, 22 bp, Artificial Sequence
  Description of Artificial Sequence: Synthetic oligonucleotide
acgactcagcgctgagtcgtgg

SEQ ID NO: 9256 - DNA, 22 bp, Artificial Sequence
  Description of Artificial Sequence: Synthetic oligonucleotide
ccgactcagcgctgagtcggct

SEQ ID NO: 9257 - DNA, 22 bp, Artificial Sequence
  Description of Artificial Sequence: Synthetic oligonucleotide
ccgactcagcgctgagtcggca

SEQ ID NO: 9258 - DNA, 22 bp, Artificial Sequence
  Description of Artificial Sequence: Synthetic oligonucleotide
gagactcagcgctgagtctcgc

SEQ ID NO: 9259 - DNA, 22 bp, Artificial Sequence
  Description of Artificial Sequence: Synthetic oligonucleotide
gtgactcagcgctgagtcacgc

SEQ ID NO: 9260 - DNA, 22 bp, Artificial Sequence
  Description of Artificial Sequence: Synthetic oligonucleotide
aggactcagcgctgagtcctgc

SEQ ID NO: 9261 - DNA, 22 bp, Artificial Sequence
  Description of Artificial Sequence: Synthetic oligonucleotide
tggactcagcgctgagtccagc

SEQ ID NO: 9262 - DNA, 22 bp, Artificial Sequence
  Description of Artificial Sequence: Synthetic oligonucleotide
aggactcagcgctgagtcctcg

SEQ ID NO: 9263 - DNA, 22 bp, Artificial Sequence
  Description of Artificial Sequence: Synthetic oligonucleotide
tggactcagcgctgagtccacg

SEQ ID NO: 9264 - DNA, 22 bp, Artificial Sequence
  Description of Artificial Sequence: Synthetic oligonucleotide
ccgactcagcgctgagtcggtg

SEQ ID NO: 9265 - DNA, 22 bp, Artificial Sequence
  Description of Artificial Sequence: Synthetic oligonucleotide
ccgactcagcgctgagtcggag

SEQ ID NO: 9266 - DNA, 22 bp, Artificial Sequence
  Description of Artificial Sequence: Synthetic oligonucleotide
gggactcagcgctgagtcccgc

SEQ ID NO: 9267 - DNA, 22 bp, Artificial Sequence
  Description of Artificial Sequence: Synthetic oligonucleotide
gggactcagcgctgagtccctc

SEQ ID NO: 9268 - DNA, 22 bp, Artificial Sequence
  Description of Artificial Sequence: Synthetic oligonucleotide
gggactcagcgctgagtcccac

SEQ ID NO: 9269 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaaatttgagtcnnnn

SEQ ID NO: 9270 - DNA, 22 bp, Artificial Sequence
  Description of Artificial Sequence: Synthetic oligonucleotide
cggactcaaatttgagtccgcc

SEQ ID NO: 9271 - DNA, 22 bp, Artificial Sequence
  Description of Artificial Sequence: Synthetic oligonucleotide
cggactcaaatttgagtccgct

SEQ ID NO: 9272 - DNA, 22 bp, Artificial Sequence
  Description of Artificial Sequence: Synthetic oligonucleotide
cggactcaaatttgagtccgtc

SEQ ID NO: 9273 - DNA, 22 bp, Artificial Sequence
  Description of Artificial Sequence: Synthetic oligonucleotide
aggactcaaatttgagtcctcc

SEQ ID NO: 9274 - DNA, 22 bp, Artificial Sequence
  Description of Artificial Sequence: Synthetic oligonucleotide
cagactcaaatttgagtctgcc

SEQ ID NO: 9275 - DNA, 22 bp, Artificial Sequence
  Description of Artificial Sequence: Synthetic oligonucleotide
cggactcaaatttgagtccgca

SEQ ID NO: 9276 - DNA, 22 bp, Artificial Sequence
  Description of Artificial Sequence: Synthetic oligonucleotide
cggactcaaatttgagtccgac

SEQ ID NO: 9277 - DNA, 22 bp, Artificial Sequence
  Description of Artificial Sequence: Synthetic oligonucleotide
tggactcaaatttgagtccacc

SEQ ID NO: 9278 - DNA, 22 bp, Artificial Sequence
  Description of Artificial Sequence: Synthetic oligonucleotide
ctgactcaaatttgagtcagcc

SEQ ID NO: 9279 - DNA, 22 bp, Artificial Sequence
  Description of Artificial Sequence: Synthetic oligonucleotide
ccgactcaaatttgagtcgggc

SEQ ID NO: 9280 - DNA, 22 bp, Artificial Sequence
  Description of Artificial Sequence: Synthetic oligonucleotide
ccgactcaaatttgagtcgggt

SEQ ID NO: 9281 - DNA, 22 bp, Artificial Sequence
  Description of Artificial Sequence: Synthetic oligonucleotide
ccgactcaaatttgagtcggtc

SEQ ID NO: 9282 - DNA, 22 bp, Artificial Sequence
  Description of Artificial Sequence: Synthetic oligonucleotide
acgactcaaatttgagtcgtgc

SEQ ID NO: 9283 - DNA, 22 bp, Artificial Sequence
  Description of Artificial Sequence: Synthetic oligonucleotide
cagactcaaatttgagtctggc

SEQ ID NO: 9284 - DNA, 22 bp, Artificial Sequence
  Description of Artificial Sequence: Synthetic oligonucleotide
ccgactcaaatttgagtcggga

SEQ ID NO: 9285 - DNA, 22 bp, Artificial Sequence
  Description of Artificial Sequence: Synthetic oligonucleotide
ccgactcaaatttgagtcggac

SEQ ID NO: 9286 - DNA, 22 bp, Artificial Sequence
  Description of Artificial Sequence: Synthetic oligonucleotide
ctgactcaaatttgagtcaggc

SEQ ID NO: 9287 - DNA, 22 bp, Artificial Sequence
  Description of Artificial Sequence: Synthetic oligonucleotide
gcgactcaaatttgagtcgccc

SEQ ID NO: 9288 - DNA, 22 bp, Artificial Sequence
  Description of Artificial Sequence: Synthetic oligonucleotide
gcgactcaaatttgagtcgcct

SEQ ID NO: 9289 - DNA, 22 bp, Artificial Sequence
  Description of Artificial Sequence: Synthetic oligonucleotide
gcgactcaaatttgagtcgctc

SEQ ID NO: 9290 - DNA, 22 bp, Artificial Sequence
  Description of Artificial Sequence: Synthetic oligonucleotide
acgactcaaatttgagtcgtcc

SEQ ID NO: 9291 - DNA, 22 bp, Artificial Sequence
  Description of Artificial Sequence: Synthetic oligonucleotide
gagactcaaatttgagtctccc

SEQ ID NO: 9292 - DNA, 22 bp, Artificial Sequence
  Description of Artificial Sequence: Synthetic oligonucleotide
gcgactcaaatttgagtcgcca

SEQ ID NO: 9293 - DNA, 22 bp, Artificial Sequence
  Description of Artificial Sequence: Synthetic oligonucleotide
gcgactcaaatttgagtcgcac

SEQ ID NO: 9294 - DNA, 22 bp, Artificial Sequence
  Description of Artificial Sequence: Synthetic oligonucleotide
gtgactcaaatttgagtcaccc

SEQ ID NO: 9295 - DNA, 22 bp, Artificial Sequence
  Description of Artificial Sequence: Synthetic oligonucleotide
gggactcaaatttgagtcccgt

SEQ ID NO: 9296 - DNA, 22 bp, Artificial Sequence
  Description of Artificial Sequence: Synthetic oligonucleotide
gggactcaaatttgagtccctg

SEQ ID NO: 9297 - DNA, 22 bp, Artificial Sequence
  Description of Artificial Sequence: Synthetic oligonucleotide
aggactcaaatttgagtcctgg

SEQ ID NO: 9298 - DNA, 22 bp, Artificial Sequence
  Description of Artificial Sequence: Synthetic oligonucleotide
gagactcaaatttgagtctcgg

SEQ ID NO: 9299 - DNA, 22 bp, Artificial Sequence
  Description of Artificial Sequence: Synthetic oligonucleotide
gggactcaaatttgagtcccga

SEQ ID NO: 9300 - DNA, 22 bp, Artificial Sequence
  Description of Artificial Sequence: Synthetic oligonucleotide
gggactcaaatttgagtcccag

SEQ ID NO: 9301 - DNA, 22 bp, Artificial Sequence
  Description of Artificial Sequence: Synthetic oligonucleotide
tggactcaaatttgagtccagg

SEQ ID NO: 9302 - DNA, 22 bp, Artificial Sequence
  Description of Artificial Sequence: Synthetic oligonucleotide
gtgactcaaatttgagtcacgg

SEQ ID NO: 9303 - DNA, 22 bp, Artificial Sequence
  Description of Artificial Sequence: Synthetic oligonucleotide
gcgactcaaatttgagtcgccg

SEQ ID NO: 9304 - DNA, 22 bp, Artificial Sequence
  Description of Artificial Sequence: Synthetic oligonucleotide
gcgactcaaatttgagtcgctg

SEQ ID NO: 9305 - DNA, 22 bp, Artificial Sequence
  Description of Artificial Sequence: Synthetic oligonucleotide
acgactcaaatttgagtcgtcg

SEQ ID NO: 9306 - DNA, 22 bp, Artificial Sequence
  Description of Artificial Sequence: Synthetic oligonucleotide
gagactcaaatttgagtctccg

SEQ ID NO: 9307 - DNA, 22 bp, Artificial Sequence
  Description of Artificial Sequence: Synthetic oligonucleotide
gcgactcaaatttgagtcgcag

SEQ ID NO: 9308 - DNA, 22 bp, Artificial Sequence
  Description of Artificial Sequence: Synthetic oligonucleotide
gtgactcaaatttgagtcaccg

SEQ ID NO: 9309 - DNA, 22 bp, Artificial Sequence
  Description of Artificial Sequence: Synthetic oligonucleotide
cggactcaaatttgagtccgtg

SEQ ID NO: 9310 - DNA, 22 bp, Artificial Sequence
  Description of Artificial Sequence: Synthetic oligonucleotide
cagactcaaatttgagtctggg

SEQ ID NO: 9311 - DNA, 22 bp, Artificial Sequence
  Description of Artificial Sequence: Synthetic oligonucleotide
cggactcaaatttgagtccgag

SEQ ID NO: 9312 - DNA, 22 bp, Artificial Sequence
  Description of Artificial Sequence: Synthetic oligonucleotide
ctgactcaaatttgagtcaggg

SEQ ID NO: 9313 - DNA, 22 bp, Artificial Sequence
  Description of Artificial Sequence: Synthetic oligonucleotide
acgactcaaatttgagtcgtgg

SEQ ID NO: 9314 - DNA, 22 bp, Artificial Sequence
  Description of Artificial Sequence: Synthetic oligonucleotide
ccgactcaaatttgagtcggct

SEQ ID NO: 9315 - DNA, 22 bp, Artificial Sequence
  Description of Artificial Sequence: Synthetic oligonucleotide
ccgactcaaatttgagtcggca

SEQ ID NO: 9316 - DNA, 22 bp, Artificial Sequence
  Description of Artificial Sequence: Synthetic oligonucleotide
gagactcaaatttgagtctcgc

SEQ ID NO: 9317 - DNA, 22 bp, Artificial Sequence
  Description of Artificial Sequence: Synthetic oligonucleotide
gtgactcaaatttgagtcacgc

SEQ ID NO: 9318 - DNA, 22 bp, Artificial Sequence
  Description of Artificial Sequence: Synthetic oligonucleotide
aggactcaaatttgagtcctgc

SEQ ID NO: 9319 - DNA, 22 bp, Artificial Sequence
  Description of Artificial Sequence: Synthetic oligonucleotide
tggactcaaatttgagtccagc

SEQ ID NO: 9320 - DNA, 22 bp, Artificial Sequence
  Description of Artificial Sequence: Synthetic oligonucleotide
aggactcaaatttgagtcctcg

SEQ ID NO: 9321 - DNA, 22 bp, Artificial Sequence
  Description of Artificial Sequence: Synthetic oligonucleotide
tggactcaaatttgagtccacg

SEQ ID NO: 9322 - DNA, 22 bp, Artificial Sequence
  Description of Artificial Sequence: Synthetic oligonucleotide
ccgactcaaatttgagtcggtg

SEQ ID NO: 9323 - DNA, 22 bp, Artificial Sequence
  Description of Artificial Sequence: Synthetic oligonucleotide
ccgactcaaatttgagtcggag

SEQ ID NO: 9324 - DNA, 22 bp, Artificial Sequence
  Description of Artificial Sequence: Synthetic oligonucleotide
gggactcaaatttgagtcccgc

SEQ ID NO: 9325 - DNA, 22 bp, Artificial Sequence
  Description of Artificial Sequence: Synthetic oligonucleotide
gggactcaaatttgagtccctc

SEQ ID NO: 9326 - DNA, 22 bp, Artificial Sequence
  Description of Artificial Sequence: Synthetic oligonucleotide
gggactcaaatttgagtcccac

SEQ ID NO: 9327 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaatattgagtcnnnn

SEQ ID NO: 9328 - DNA, 22 bp, Artificial Sequence
  Description of Artificial Sequence: Synthetic oligonucleotide
cggactcaatattgagtccgcc

SEQ ID NO: 9329 - DNA, 22 bp, Artificial Sequence
  Description of Artificial Sequence: Synthetic oligonucleotide
cggactcaatattgagtccgct

SEQ ID NO: 9330 - DNA, 22 bp, Artificial Sequence
  Description of Artificial Sequence: Synthetic oligonucleotide
cggactcaatattgagtccgtc

SEQ ID NO: 9331 - DNA, 22 bp, Artificial Sequence
  Description of Artificial Sequence: Synthetic oligonucleotide
aggactcaatattgagtcctcc

SEQ ID NO: 9332 - DNA, 22 bp, Artificial Sequence
  Description of Artificial Sequence: Synthetic oligonucleotide
cagactcaatattgagtctgcc

SEQ ID NO: 9333 - DNA, 22 bp, Artificial Sequence
  Description of Artificial Sequence: Synthetic oligonucleotide
cggactcaatattgagtccgca

SEQ ID NO: 9334 - DNA, 22 bp, Artificial Sequence
  Description of Artificial Sequence: Synthetic oligonucleotide
cggactcaatattgagtccgac

SEQ ID NO: 9335 - DNA, 22 bp, Artificial Sequence
  Description of Artificial Sequence: Synthetic oligonucleotide
tggactcaatattgagtccacc

SEQ ID NO: 9336 - DNA, 22 bp, Artificial Sequence
  Description of Artificial Sequence: Synthetic oligonucleotide
ctgactcaatattgagtcagcc

SEQ ID NO: 9337 - DNA, 22 bp, Artificial Sequence
  Description of Artificial Sequence: Synthetic oligonucleotide
ccgactcaatattgagtcgggc

SEQ ID NO: 9338 - DNA, 22 bp, Artificial Sequence
  Description of Artificial Sequence: Synthetic oligonucleotide
ccgactcaatattgagtcgggt

SEQ ID NO: 9339 - DNA, 22 bp, Artificial Sequence
  Description of Artificial Sequence: Synthetic oligonucleotide
ccgactcaatattgagtcggtc

SEQ ID NO: 9340 - DNA, 22 bp, Artificial Sequence
  Description of Artificial Sequence: Synthetic oligonucleotide
acgactcaatattgagtcgtgc

SEQ ID NO: 9341 - DNA, 22 bp, Artificial Sequence
  Description of Artificial Sequence: Synthetic oligonucleotide
cagactcaatattgagtctggc

SEQ ID NO: 9342 - DNA, 22 bp, Artificial Sequence
  Description of Artificial Sequence: Synthetic oligonucleotide
ccgactcaatattgagtcggga

SEQ ID NO: 9343 - DNA, 22 bp, Artificial Sequence
  Description of Artificial Sequence: Synthetic oligonucleotide
ccgactcaatattgagtcggac

SEQ ID NO: 9344 - DNA, 22 bp, Artificial Sequence
  Description of Artificial Sequence: Synthetic oligonucleotide
ctgactcaatattgagtcaggc

SEQ ID NO: 9345 - DNA, 22 bp, Artificial Sequence
  Description of Artificial Sequence: Synthetic oligonucleotide
gcgactcaatattgagtcgccc

SEQ ID NO: 9346 - DNA, 22 bp, Artificial Sequence
  Description of Artificial Sequence: Synthetic oligonucleotide
gcgactcaatattgagtcgcct

SEQ ID NO: 9347 - DNA, 22 bp, Artificial Sequence
  Description of Artificial Sequence: Synthetic oligonucleotide
gcgactcaatattgagtcgctc

SEQ ID NO: 9348 - DNA, 22 bp, Artificial Sequence
  Description of Artificial Sequence: Synthetic oligonucleotide
acgactcaatattgagtcgtcc

SEQ ID NO: 9349 - DNA, 22 bp, Artificial Sequence
  Description of Artificial Sequence: Synthetic oligonucleotide
gagactcaatattgagtctccc

SEQ ID NO: 9350 - DNA, 22 bp, Artificial Sequence
  Description of Artificial Sequence: Synthetic oligonucleotide
gcgactcaatattgagtcgcca

SEQ ID NO: 9351 - DNA, 22 bp, Artificial Sequence
  Description of Artificial Sequence: Synthetic oligonucleotide
gcgactcaatattgagtcgcac

SEQ ID NO: 9352 - DNA, 22 bp, Artificial Sequence
  Description of Artificial Sequence: Synthetic oligonucleotide
gtgactcaatattgagtcaccc

SEQ ID NO: 9353 - DNA, 22 bp, Artificial Sequence
  Description of Artificial Sequence: Synthetic oligonucleotide
gggactcaatattgagtcccgt

SEQ ID NO: 9354 - DNA, 22 bp, Artificial Sequence
  Description of Artificial Sequence: Synthetic oligonucleotide
gggactcaatattgagtccctg

SEQ ID NO: 9355 - DNA, 22 bp, Artificial Sequence
  Description of Artificial Sequence: Synthetic oligonucleotide
aggactcaatattgagtcctgg

SEQ ID NO: 9356 - DNA, 22 bp, Artificial Sequence
  Description of Artificial Sequence: Synthetic oligonucleotide
gagactcaatattgagtctcgg

SEQ ID NO: 9357 - DNA, 22 bp, Artificial Sequence
  Description of Artificial Sequence: Synthetic oligonucleotide
gggactcaatattgagtcccga

SEQ ID NO: 9358 - DNA, 22 bp, Artificial Sequence
  Description of Artificial Sequence: Synthetic oligonucleotide
gggactcaatattgagtcccag

SEQ ID NO: 9359 - DNA, 22 bp, Artificial Sequence
  Description of Artificial Sequence: Synthetic oligonucleotide
tggactcaatattgagtccagg

SEQ ID NO: 9360 - DNA, 22 bp, Artificial Sequence
  Description of Artificial Sequence: Synthetic oligonucleotide
gtgactcaatattgagtcacgg

SEQ ID NO: 9361 - DNA, 22 bp, Artificial Sequence
  Description of Artificial Sequence: Synthetic oligonucleotide
gcgactcaatattgagtcgccg

SEQ ID NO: 9362 - DNA, 22 bp, Artificial Sequence
  Description of Artificial Sequence: Synthetic oligonucleotide
gcgactcaatattgagtcgctg

SEQ ID NO: 9363 - DNA, 22 bp, Artificial Sequence
  Description of Artificial Sequence: Synthetic oligonucleotide
acgactcaatattgagtcgtcg

SEQ ID NO: 9364 - DNA, 22 bp, Artificial Sequence
  Description of Artificial Sequence: Synthetic oligonucleotide
gagactcaatattgagtctccg

SEQ ID NO: 9365 - DNA, 22 bp, Artificial Sequence
  Description of Artificial Sequence: Synthetic oligonucleotide
gcgactcaatattgagtcgcag

SEQ ID NO: 9366 - DNA, 22 bp, Artificial Sequence
  Description of Artificial Sequence: Synthetic oligonucleotide
gtgactcaatattgagtcaccg

SEQ ID NO: 9367 - DNA, 22 bp, Artificial Sequence
  Description of Artificial Sequence: Synthetic oligonucleotide
cggactcaatattgagtccgtg

SEQ ID NO: 9368 - DNA, 22 bp, Artificial Sequence
  Description of Artificial Sequence: Synthetic oligonucleotide
cagactcaatattgagtctggg

SEQ ID NO: 9369 - DNA, 22 bp, Artificial Sequence
  Description of Artificial Sequence: Synthetic oligonucleotide
cggactcaatattgagtccgag

SEQ ID NO: 9370 - DNA, 22 bp, Artificial Sequence
  Description of Artificial Sequence: Synthetic oligonucleotide
ctgactcaatattgagtcaggg

SEQ ID NO: 9371 - DNA, 22 bp, Artificial Sequence
  Description of Artificial Sequence: Synthetic oligonucleotide
acgactcaatattgagtcgtgg

SEQ ID NO: 9372 - DNA, 22 bp, Artificial Sequence
  Description of Artificial Sequence: Synthetic oligonucleotide
ccgactcaatattgagtcggct

SEQ ID NO: 9373 - DNA, 22 bp, Artificial Sequence
  Description of Artificial Sequence: Synthetic oligonucleotide
ccgactcaatattgagtcggca

SEQ ID NO: 9374 - DNA, 22 bp, Artificial Sequence
  Description of Artificial Sequence: Synthetic oligonucleotide
gagactcaatattgagtctcgc

SEQ ID NO: 9375 - DNA, 22 bp, Artificial Sequence
  Description of Artificial Sequence: Synthetic oligonucleotide
gtgactcaatattgagtcacgc

SEQ ID NO: 9376 - DNA, 22 bp, Artificial Sequence
  Description of Artificial Sequence: Synthetic oligonucleotide
aggactcaatattgagtcctgc

SEQ ID NO: 9377 - DNA, 22 bp, Artificial Sequence
  Description of Artificial Sequence: Synthetic oligonucleotide
tggactcaatattgagtccagc

SEQ ID NO: 9378 - DNA, 22 bp, Artificial Sequence
  Description of Artificial Sequence: Synthetic oligonucleotide
aggactcaatattgagtcctcg

SEQ ID NO: 9379 - DNA, 22 bp, Artificial Sequence
  Description of Artificial Sequence: Synthetic oligonucleotide
tggactcaatattgagtccacg

SEQ ID NO: 9380 - DNA, 22 bp, Artificial Sequence
  Description of Artificial Sequence: Synthetic oligonucleotide
ccgactcaatattgagtcggtg

SEQ ID NO: 9381 - DNA, 22 bp, Artificial Sequence
  Description of Artificial Sequence: Synthetic oligonucleotide
ccgactcaatattgagtcggag

SEQ ID NO: 9382 - DNA, 22 bp, Artificial Sequence
  Description of Artificial Sequence: Synthetic oligonucleotide
gggactcaatattgagtcccgc

SEQ ID NO: 9383 - DNA, 22 bp, Artificial Sequence
  Description of Artificial Sequence: Synthetic oligonucleotide
gggactcaatattgagtccctc

SEQ ID NO: 9384 - DNA, 22 bp, Artificial Sequence
  Description of Artificial Sequence: Synthetic oligonucleotide
gggactcaatattgagtcccac

SEQ ID NO: 9385 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaagcttgagtcnnnn

SEQ ID NO: 9386 - DNA, 22 bp, Artificial Sequence
  Description of Artificial Sequence: Synthetic oligonucleotide
cggactcaagcttgagtccgcc

SEQ ID NO: 9387 - DNA, 22 bp, Artificial Sequence
  Description of Artificial Sequence: Synthetic oligonucleotide
cggactcaagcttgagtccgct

SEQ ID NO: 9388 - DNA, 22 bp, Artificial Sequence
  Description of Artificial Sequence: Synthetic oligonucleotide
cggactcaagcttgagtccgtc

SEQ ID NO: 9389 - DNA, 22 bp, Artificial Sequence
  Description of Artificial Sequence: Synthetic oligonucleotide
aggactcaagcttgagtcctcc

SEQ ID NO: 9390 - DNA, 22 bp, Artificial Sequence
  Description of Artificial Sequence: Synthetic oligonucleotide
cagactcaagcttgagtctgcc

SEQ ID NO: 9391 - DNA, 22 bp, Artificial Sequence
  Description of Artificial Sequence: Synthetic oligonucleotide
cggactcaagcttgagtccgca

SEQ ID NO: 9392 - DNA, 22 bp, Artificial Sequence
  Description of Artificial Sequence: Synthetic oligonucleotide
cggactcaagcttgagtccgac

SEQ ID NO: 9393 - DNA, 22 bp, Artificial Sequence
  Description of Artificial Sequence: Synthetic oligonucleotide
tggactcaagcttgagtccacc

SEQ ID NO: 9394 - DNA, 22 bp, Artificial Sequence
  Description of Artificial Sequence: Synthetic oligonucleotide
ctgactcaagcttgagtcagcc

SEQ ID NO: 9395 - DNA, 22 bp, Artificial Sequence
  Description of Artificial Sequence: Synthetic oligonucleotide
ccgactcaagcttgagtcgggc

SEQ ID NO: 9396 - DNA, 22 bp, Artificial Sequence
  Description of Artificial Sequence: Synthetic oligonucleotide
ccgactcaagcttgagtcgggt

SEQ ID NO: 9397 - DNA, 22 bp, Artificial Sequence
  Description of Artificial Sequence: Synthetic oligonucleotide
ccgactcaagcttgagtcggtc

SEQ ID NO: 9398 - DNA, 22 bp, Artificial Sequence
  Description of Artificial Sequence: Synthetic oligonucleotide
acgactcaagcttgagtcgtgc

SEQ ID NO: 9399 - DNA, 22 bp, Artificial Sequence
  Description of Artificial Sequence: Synthetic oligonucleotide
cagactcaagcttgagtctggc

SEQ ID NO: 9400 - DNA, 22 bp, Artificial Sequence
  Description of Artificial Sequence: Synthetic oligonucleotide
ccgactcaagcttgagtcggga

SEQ ID NO: 9401 - DNA, 22 bp, Artificial Sequence
  Description of Artificial Sequence: Synthetic oligonucleotide
ccgactcaagcttgagtcggac

SEQ ID NO: 9402 - DNA, 22 bp, Artificial Sequence
  Description of Artificial Sequence: Synthetic oligonucleotide
ctgactcaagcttgagtcaggc

SEQ ID NO: 9403 - DNA, 22 bp, Artificial Sequence
  Description of Artificial Sequence: Synthetic oligonucleotide
gcgactcaagcttgagtcgccc

SEQ ID NO: 9404 - DNA, 22 bp, Artificial Sequence
  Description of Artificial Sequence: Synthetic oligonucleotide
gcgactcaagcttgagtcgcct

SEQ ID NO: 9405 - DNA, 22 bp, Artificial Sequence
  Description of Artificial Sequence: Synthetic oligonucleotide
gcgactcaagcttgagtcgctc

SEQ ID NO: 9406 - DNA, 22 bp, Artificial Sequence
  Description of Artificial Sequence: Synthetic oligonucleotide
acgactcaagcttgagtcgtcc

SEQ ID NO: 9407 - DNA, 22 bp, Artificial Sequence
  Description of Artificial Sequence: Synthetic oligonucleotide
gagactcaagcttgagtctccc

SEQ ID NO: 9408 - DNA, 22 bp, Artificial Sequence
  Description of Artificial Sequence: Synthetic oligonucleotide
gcgactcaagcttgagtcgcca

SEQ ID NO: 9409 - DNA, 22 bp, Artificial Sequence
  Description of Artificial Sequence: Synthetic oligonucleotide
gcgactcaagcttgagtcgcac

SEQ ID NO: 9410 - DNA, 22 bp, Artificial Sequence
  Description of Artificial Sequence: Synthetic oligonucleotide
gtgactcaagcttgagtcaccc

SEQ ID NO: 9411 - DNA, 22 bp, Artificial Sequence
  Description of Artificial Sequence: Synthetic oligonucleotide
gggactcaagcttgagtcccgt

SEQ ID NO: 9412 - DNA, 22 bp, Artificial Sequence
  Description of Artificial Sequence: Synthetic oligonucleotide
gggactcaagcttgagtccctg

SEQ ID NO: 9413 - DNA, 22 bp, Artificial Sequence
  Description of Artificial Sequence: Synthetic oligonucleotide
aggactcaagcttgagtcctgg

SEQ ID NO: 9414 - DNA, 22 bp, Artificial Sequence
  Description of Artificial Sequence: Synthetic oligonucleotide
gagactcaagcttgagtctcgg

SEQ ID NO: 9415 - DNA, 22 bp, Artificial Sequence
  Description of Artificial Sequence: Synthetic oligonucleotide
gggactcaagcttgagtcccga

SEQ ID NO: 9416 - DNA, 22 bp, Artificial Sequence
  Description of Artificial Sequence: Synthetic oligonucleotide
gggactcaagcttgagtcccag

SEQ ID NO: 9417 - DNA, 22 bp, Artificial Sequence
  Description of Artificial Sequence: Synthetic oligonucleotide
tggactcaagcttgagtccagg

SEQ ID NO: 9418 - DNA, 22 bp, Artificial Sequence
  Description of Artificial Sequence: Synthetic oligonucleotide
gtgactcaagcttgagtcacgg

SEQ ID NO: 9419 - DNA, 22 bp, Artificial Sequence
  Description of Artificial Sequence: Synthetic oligonucleotide
gcgactcaagcttgagtcgccg

SEQ ID NO: 9420 - DNA, 22 bp, Artificial Sequence
  Description of Artificial Sequence: Synthetic oligonucleotide
gcgactcaagcttgagtcgctg

SEQ ID NO: 9421 - DNA, 22 bp, Artificial Sequence
  Description of Artificial Sequence: Synthetic oligonucleotide
acgactcaagcttgagtcgtcg

SEQ ID NO: 9422 - DNA, 22 bp, Artificial Sequence
  Description of Artificial Sequence: Synthetic oligonucleotide
gagactcaagcttgagtctccg

SEQ ID NO: 9423 - DNA, 22 bp, Artificial Sequence
  Description of Artificial Sequence: Synthetic oligonucleotide
gcgactcaagcttgagtcgcag

SEQ ID NO: 9424 - DNA, 22 bp, Artificial Sequence
  Description of Artificial Sequence: Synthetic oligonucleotide
gtgactcaagcttgagtcaccg

SEQ ID NO: 9425 - DNA, 22 bp, Artificial Sequence
  Description of Artificial Sequence: Synthetic oligonucleotide
cggactcaagcttgagtccgtg

SEQ ID NO: 9426 - DNA, 22 bp, Artificial Sequence
  Description of Artificial Sequence: Synthetic oligonucleotide
cagactcaagcttgagtctggg

SEQ ID NO: 9427 - DNA, 22 bp, Artificial Sequence
  Description of Artificial Sequence: Synthetic oligonucleotide
cggactcaagcttgagtccgag

SEQ ID NO: 9428 - DNA, 22 bp, Artificial Sequence
  Description of Artificial Sequence: Synthetic oligonucleotide
ctgactcaagcttgagtcaggg

SEQ ID NO: 9429 - DNA, 22 bp, Artificial Sequence
  Description of Artificial Sequence: Synthetic oligonucleotide
acgactcaagcttgagtcgtgg

SEQ ID NO: 9430 - DNA, 22 bp, Artificial Sequence
  Description of Artificial Sequence: Synthetic oligonucleotide
ccgactcaagcttgagtcggct

SEQ ID NO: 9431 - DNA, 22 bp, Artificial Sequence
  Description of Artificial Sequence: Synthetic oligonucleotide
ccgactcaagcttgagtcggca

SEQ ID NO: 9432 - DNA, 22 bp, Artificial Sequence
  Description of Artificial Sequence: Synthetic oligonucleotide
gagactcaagcttgagtctcgc

SEQ ID NO: 9433 - DNA, 22 bp, Artificial Sequence
  Description of Artificial Sequence: Synthetic oligonucleotide
gtgactcaagcttgagtcacgc

SEQ ID NO: 9434 - DNA, 22 bp, Artificial Sequence
  Description of Artificial Sequence: Synthetic oligonucleotide
aggactcaagcttgagtcctgc

SEQ ID NO: 9435 - DNA, 22 bp, Artificial Sequence
  Description of Artificial Sequence: Synthetic oligonucleotide
tggactcaagcttgagtccagc

SEQ ID NO: 9436 - DNA, 22 bp, Artificial Sequence
  Description of Artificial Sequence: Synthetic oligonucleotide
aggactcaagcttgagtcctcg

SEQ ID NO: 9437 - DNA, 22 bp, Artificial Sequence
  Description of Artificial Sequence: Synthetic oligonucleotide
tggactcaagcttgagtccacg

SEQ ID NO: 9438 - DNA, 22 bp, Artificial Sequence
  Description of Artificial Sequence: Synthetic oligonucleotide
ccgactcaagcttgagtcggtg

SEQ ID NO: 9439 - DNA, 22 bp, Artificial Sequence
  Description of Artificial Sequence: Synthetic oligonucleotide
ccgactcaagcttgagtcggag

SEQ ID NO: 9440 - DNA, 22 bp, Artificial Sequence
  Description of Artificial Sequence: Synthetic oligonucleotide
gggactcaagcttgagtcccgc

SEQ ID NO: 9441 - DNA, 22 bp, Artificial Sequence
  Description of Artificial Sequence: Synthetic oligonucleotide
gggactcaagcttgagtccctc

SEQ ID NO: 9442 - DNA, 22 bp, Artificial Sequence
  Description of Artificial Sequence: Synthetic oligonucleotide
gggactcaagcttgagtcccac

SEQ ID NO: 9443 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcaacgttgagtcnnnn

SEQ ID NO: 9444 - DNA, 22 bp, Artificial Sequence
  Description of Artificial Sequence: Synthetic oligonucleotide
cggactcaacgttgagtccgcc

SEQ ID NO: 9445 - DNA, 22 bp, Artificial Sequence
  Description of Artificial Sequence: Synthetic oligonucleotide
cggactcaacgttgagtccgct

SEQ ID NO: 9446 - DNA, 22 bp, Artificial Sequence
  Description of Artificial Sequence: Synthetic oligonucleotide
cggactcaacgttgagtccgtc

SEQ ID NO: 9447 - DNA, 22 bp, Artificial Sequence
  Description of Artificial Sequence: Synthetic oligonucleotide
aggactcaacgttgagtcctcc

SEQ ID NO: 9448 - DNA, 22 bp, Artificial Sequence
  Description of Artificial Sequence: Synthetic oligonucleotide
cagactcaacgttgagtctgcc

SEQ ID NO: 9449 - DNA, 22 bp, Artificial Sequence
  Description of Artificial Sequence: Synthetic oligonucleotide
cggactcaacgttgagtccgca

SEQ ID NO: 9450 - DNA, 22 bp, Artificial Sequence
  Description of Artificial Sequence: Synthetic oligonucleotide
cggactcaacgttgagtccgac

SEQ ID NO: 9451 - DNA, 22 bp, Artificial Sequence
  Description of Artificial Sequence: Synthetic oligonucleotide
tggactcaacgttgagtccacc

SEQ ID NO: 9452 - DNA, 22 bp, Artificial Sequence
  Description of Artificial Sequence: Synthetic oligonucleotide
ctgactcaacgttgagtcagcc

SEQ ID NO: 9453 - DNA, 22 bp, Artificial Sequence
  Description of Artificial Sequence: Synthetic oligonucleotide
ccgactcaacgttgagtcgggc

SEQ ID NO: 9454 - DNA, 22 bp, Artificial Sequence
  Description of Artificial Sequence: Synthetic oligonucleotide
ccgactcaacgttgagtcgggt

SEQ ID NO: 9455 - DNA, 22 bp, Artificial Sequence
  Description of Artificial Sequence: Synthetic oligonucleotide
ccgactcaacgttgagtcggtc

SEQ ID NO: 9456 - DNA, 22 bp, Artificial Sequence
  Description of Artificial Sequence: Synthetic oligonucleotide
acgactcaacgttgagtcgtgc

SEQ ID NO: 9457 - DNA, 22 bp, Artificial Sequence
  Description of Artificial Sequence: Synthetic oligonucleotide
cagactcaacgttgagtctggc

SEQ ID NO: 9458 - DNA, 22 bp, Artificial Sequence
  Description of Artificial Sequence: Synthetic oligonucleotide
ccgactcaacgttgagtcggga

SEQ ID NO: 9459 - DNA, 22 bp, Artificial Sequence
  Description of Artificial Sequence: Synthetic oligonucleotide
ccgactcaacgttgagtcggac

SEQ ID NO: 9460 - DNA, 22 bp, Artificial Sequence
  Description of Artificial Sequence: Synthetic oligonucleotide
ctgactcaacgttgagtcaggc

SEQ ID NO: 9461 - DNA, 22 bp, Artificial Sequence
  Description of Artificial Sequence: Synthetic oligonucleotide
gcgactcaacgttgagtcgccc

SEQ ID NO: 9462 - DNA, 22 bp, Artificial Sequence
  Description of Artificial Sequence: Synthetic oligonucleotide
gcgactcaacgttgagtcgcct

SEQ ID NO: 9463 - DNA, 22 bp, Artificial Sequence
  Description of Artificial Sequence: Synthetic oligonucleotide
gcgactcaacgttgagtcgctc

SEQ ID NO: 9464 - DNA, 22 bp, Artificial Sequence
  Description of Artificial Sequence: Synthetic oligonucleotide
acgactcaacgttgagtcgtcc

SEQ ID NO: 9465 - DNA, 22 bp, Artificial Sequence
  Description of Artificial Sequence: Synthetic oligonucleotide
gagactcaacgttgagtctccc

SEQ ID NO: 9466 - DNA, 22 bp, Artificial Sequence
  Description of Artificial Sequence: Synthetic oligonucleotide
gcgactcaacgttgagtcgcca

SEQ ID NO: 9467 - DNA, 22 bp, Artificial Sequence
  Description of Artificial Sequence: Synthetic oligonucleotide
gcgactcaacgttgagtcgcac

SEQ ID NO: 9468 - DNA, 22 bp, Artificial Sequence
  Description of Artificial Sequence: Synthetic oligonucleotide
gtgactcaacgttgagtcaccc

SEQ ID NO: 9469 - DNA, 22 bp, Artificial Sequence
  Description of Artificial Sequence: Synthetic oligonucleotide
gggactcaacgttgagtcccgt

SEQ ID NO: 9470 - DNA, 22 bp, Artificial Sequence
  Description of Artificial Sequence: Synthetic oligonucleotide
gggactcaacgttgagtccctg

SEQ ID NO: 9471 - DNA, 22 bp, Artificial Sequence
  Description of Artificial Sequence: Synthetic oligonucleotide
aggactcaacgttgagtcctgg

SEQ ID NO: 9472 - DNA, 22 bp, Artificial Sequence
  Description of Artificial Sequence: Synthetic oligonucleotide
gagactcaacgttgagtctcgg

SEQ ID NO: 9473 - DNA, 22 bp, Artificial Sequence
  Description of Artificial Sequence: Synthetic oligonucleotide
gggactcaacgttgagtcccga

SEQ ID NO: 9474 - DNA, 22 bp, Artificial Sequence
  Description of Artificial Sequence: Synthetic oligonucleotide
gggactcaacgttgagtcccag

SEQ ID NO: 9475 - DNA, 22 bp, Artificial Sequence
  Description of Artificial Sequence: Synthetic oligonucleotide
tggactcaacgttgagtccagg

SEQ ID NO: 9476 - DNA, 22 bp, Artificial Sequence
  Description of Artificial Sequence: Synthetic oligonucleotide
gtgactcaacgttgagtcacgg

SEQ ID NO: 9477 - DNA, 22 bp, Artificial Sequence
  Description of Artificial Sequence: Synthetic oligonucleotide
gcgactcaacgttgagtcgccg

SEQ ID NO: 9478 - DNA, 22 bp, Artificial Sequence
  Description of Artificial Sequence: Synthetic oligonucleotide
gcgactcaacgttgagtcgctg

SEQ ID NO: 9479 - DNA, 22 bp, Artificial Sequence
  Description of Artificial Sequence: Synthetic oligonucleotide
acgactcaacgttgagtcgtcg

SEQ ID NO: 9480 - DNA, 22 bp, Artificial Sequence
  Description of Artificial Sequence: Synthetic oligonucleotide
gagactcaacgttgagtctccg

SEQ ID NO: 9481 - DNA, 22 bp, Artificial Sequence
  Description of Artificial Sequence: Synthetic oligonucleotide
gcgactcaacgttgagtcgcag

SEQ ID NO: 9482 - DNA, 22 bp, Artificial Sequence
  Description of Artificial Sequence: Synthetic oligonucleotide
gtgactcaacgttgagtcaccg

SEQ ID NO: 9483 - DNA, 22 bp, Artificial Sequence
  Description of Artificial Sequence: Synthetic oligonucleotide
cggactcaacgttgagtccgtg

SEQ ID NO: 9484 - DNA, 22 bp, Artificial Sequence
  Description of Artificial Sequence: Synthetic oligonucleotide
cagactcaacgttgagtctggg

SEQ ID NO: 9485 - DNA, 22 bp, Artificial Sequence
  Description of Artificial Sequence: Synthetic oligonucleotide
cggactcaacgttgagtccgag

SEQ ID NO: 9486 - DNA, 22 bp, Artificial Sequence
  Description of Artificial Sequence: Synthetic oligonucleotide
ctgactcaacgttgagtcaggg

SEQ ID NO: 9487 - DNA, 22 bp, Artificial Sequence
  Description of Artificial Sequence: Synthetic oligonucleotide
acgactcaacgttgagtcgtgg

SEQ ID NO: 9488 - DNA, 22 bp, Artificial Sequence
  Description of Artificial Sequence: Synthetic oligonucleotide
ccgactcaacgttgagtcggct

SEQ ID NO: 9489 - DNA, 22 bp, Artificial Sequence
  Description of Artificial Sequence: Synthetic oligonucleotide
ccgactcaacgttgagtcggca

SEQ ID NO: 9490 - DNA, 22 bp, Artificial Sequence
  Description of Artificial Sequence: Synthetic oligonucleotide
gagactcaacgttgagtctcgc

SEQ ID NO: 9491 - DNA, 22 bp, Artificial Sequence
  Description of Artificial Sequence: Synthetic oligonucleotide
gtgactcaacgttgagtcacgc

SEQ ID NO: 9492 - DNA, 22 bp, Artificial Sequence
  Description of Artificial Sequence: Synthetic oligonucleotide
aggactcaacgttgagtcctgc

SEQ ID NO: 9493 - DNA, 22 bp, Artificial Sequence
  Description of Artificial Sequence: Synthetic oligonucleotide
tggactcaacgttgagtccagc

SEQ ID NO: 9494 - DNA, 22 bp, Artificial Sequence
  Description of Artificial Sequence: Synthetic oligonucleotide
aggactcaacgttgagtcctcg

SEQ ID NO: 9495 - DNA, 22 bp, Artificial Sequence
  Description of Artificial Sequence: Synthetic oligonucleotide
tggactcaacgttgagtccacg

SEQ ID NO: 9496 - DNA, 22 bp, Artificial Sequence
  Description of Artificial Sequence: Synthetic oligonucleotide
ccgactcaacgttgagtcggtg

SEQ ID NO: 9497 - DNA, 22 bp, Artificial Sequence
  Description of Artificial Sequence: Synthetic oligonucleotide
ccgactcaacgttgagtcggag

SEQ ID NO: 9498 - DNA, 22 bp, Artificial Sequence
  Description of Artificial Sequence: Synthetic oligonucleotide
gggactcaacgttgagtcccgc

SEQ ID NO: 9499 - DNA, 22 bp, Artificial Sequence
  Description of Artificial Sequence: Synthetic oligonucleotide
gggactcaacgttgagtccctc

SEQ ID NO: 9500 - DNA, 22 bp, Artificial Sequence
  Description of Artificial Sequence: Synthetic oligonucleotide
gggactcaacgttgagtcccac

SEQ ID NO: 9501 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctaattagagtcnnnn

SEQ ID NO: 9502 - DNA, 22 bp, Artificial Sequence
  Description of Artificial Sequence: Synthetic oligonucleotide
cggactctaattagagtccgcc

SEQ ID NO: 9503 - DNA, 22 bp, Artificial Sequence
  Description of Artificial Sequence: Synthetic oligonucleotide
cggactctaattagagtccgct

SEQ ID NO: 9504 - DNA, 22 bp, Artificial Sequence
  Description of Artificial Sequence: Synthetic oligonucleotide
cggactctaattagagtccgtc

SEQ ID NO: 9505 - DNA, 22 bp, Artificial Sequence
  Description of Artificial Sequence: Synthetic oligonucleotide
aggactctaattagagtcctcc

SEQ ID NO: 9506 - DNA, 22 bp, Artificial Sequence
  Description of Artificial Sequence: Synthetic oligonucleotide
cagactctaattagagtctgcc

SEQ ID NO: 9507 - DNA, 22 bp, Artificial Sequence
  Description of Artificial Sequence: Synthetic oligonucleotide
cggactctaattagagtccgca

SEQ ID NO: 9508 - DNA, 22 bp, Artificial Sequence
  Description of Artificial Sequence: Synthetic oligonucleotide
cggactctaattagagtccgac

SEQ ID NO: 9509 - DNA, 22 bp, Artificial Sequence
  Description of Artificial Sequence: Synthetic oligonucleotide
tggactctaattagagtccacc

SEQ ID NO: 9510 - DNA, 22 bp, Artificial Sequence
  Description of Artificial Sequence: Synthetic oligonucleotide
ctgactctaattagagtcagcc

SEQ ID NO: 9511 - DNA, 22 bp, Artificial Sequence
  Description of Artificial Sequence: Synthetic oligonucleotide
ccgactctaattagagtcgggc

SEQ ID NO: 9512 - DNA, 22 bp, Artificial Sequence
  Description of Artificial Sequence: Synthetic oligonucleotide
ccgactctaattagagtcgggt

SEQ ID NO: 9513 - DNA, 22 bp, Artificial Sequence
  Description of Artificial Sequence: Synthetic oligonucleotide
ccgactctaattagagtcggtc

SEQ ID NO: 9514 - DNA, 22 bp, Artificial Sequence
  Description of Artificial Sequence: Synthetic oligonucleotide
acgactctaattagagtcgtgc

SEQ ID NO: 9515 - DNA, 22 bp, Artificial Sequence
  Description of Artificial Sequence: Synthetic oligonucleotide
cagactctaattagagtctggc

SEQ ID NO: 9516 - DNA, 22 bp, Artificial Sequence
  Description of Artificial Sequence: Synthetic oligonucleotide
ccgactctaattagagtcggga

SEQ ID NO: 9517 - DNA, 22 bp, Artificial Sequence
  Description of Artificial Sequence: Synthetic oligonucleotide
ccgactctaattagagtcggac

SEQ ID NO: 9518 - DNA, 22 bp, Artificial Sequence
  Description of Artificial Sequence: Synthetic oligonucleotide
ctgactctaattagagtcaggc

SEQ ID NO: 9519 - DNA, 22 bp, Artificial Sequence
  Description of Artificial Sequence: Synthetic oligonucleotide
gcgactctaattagagtcgccc

SEQ ID NO: 9520 - DNA, 22 bp, Artificial Sequence
  Description of Artificial Sequence: Synthetic oligonucleotide
gcgactctaattagagtcgcct

SEQ ID NO: 9521 - DNA, 22 bp, Artificial Sequence
  Description of Artificial Sequence: Synthetic oligonucleotide
gcgactctaattagagtcgctc

SEQ ID NO: 9522 - DNA, 22 bp, Artificial Sequence
  Description of Artificial Sequence: Synthetic oligonucleotide
acgactctaattagagtcgtcc

SEQ ID NO: 9523 - DNA, 22 bp, Artificial Sequence
  Description of Artificial Sequence: Synthetic oligonucleotide
gagactctaattagagtctccc

SEQ ID NO: 9524 - DNA, 22 bp, Artificial Sequence
  Description of Artificial Sequence: Synthetic oligonucleotide
gcgactctaattagagtcgcca

SEQ ID NO: 9525 - DNA, 22 bp, Artificial Sequence
  Description of Artificial Sequence: Synthetic oligonucleotide
gcgactctaattagagtcgcac

SEQ ID NO: 9526 - DNA, 22 bp, Artificial Sequence
  Description of Artificial Sequence: Synthetic oligonucleotide
gtgactctaattagagtcaccc

SEQ ID NO: 9527 - DNA, 22 bp, Artificial Sequence
  Description of Artificial Sequence: Synthetic oligonucleotide
gggactctaattagagtcccgt

SEQ ID NO: 9528 - DNA, 22 bp, Artificial Sequence
  Description of Artificial Sequence: Synthetic oligonucleotide
gggactctaattagagtccctg

SEQ ID NO: 9529 - DNA, 22 bp, Artificial Sequence
  Description of Artificial Sequence: Synthetic oligonucleotide
aggactctaattagagtcctgg

SEQ ID NO: 9530 - DNA, 22 bp, Artificial Sequence
  Description of Artificial Sequence: Synthetic oligonucleotide
gagactctaattagagtctcgg

SEQ ID NO: 9531 - DNA, 22 bp, Artificial Sequence
  Description of Artificial Sequence: Synthetic oligonucleotide
gggactctaattagagtcccga

SEQ ID NO: 9532 - DNA, 22 bp, Artificial Sequence
  Description of Artificial Sequence: Synthetic oligonucleotide
gggactctaattagagtcccag

SEQ ID NO: 9533 - DNA, 22 bp, Artificial Sequence
  Description of Artificial Sequence: Synthetic oligonucleotide
tggactctaattagagtccagg

SEQ ID NO: 9534 - DNA, 22 bp, Artificial Sequence
  Description of Artificial Sequence: Synthetic oligonucleotide
gtgactctaattagagtcacgg

SEQ ID NO: 9535 - DNA, 22 bp, Artificial Sequence
  Description of Artificial Sequence: Synthetic oligonucleotide
gcgactctaattagagtcgccg

SEQ ID NO: 9536 - DNA, 22 bp, Artificial Sequence
  Description of Artificial Sequence: Synthetic oligonucleotide
gcgactctaattagagtcgctg

SEQ ID NO: 9537 - DNA, 22 bp, Artificial Sequence
  Description of Artificial Sequence: Synthetic oligonucleotide
acgactctaattagagtcgtcg

SEQ ID NO: 9538 - DNA, 22 bp, Artificial Sequence
  Description of Artificial Sequence: Synthetic oligonucleotide
gagactctaattagagtctccg

SEQ ID NO: 9539 - DNA, 22 bp, Artificial Sequence
  Description of Artificial Sequence: Synthetic oligonucleotide
gcgactctaattagagtcgcag

SEQ ID NO: 9540 - DNA, 22 bp, Artificial Sequence
  Description of Artificial Sequence: Synthetic oligonucleotide
gtgactctaattagagtcaccg

SEQ ID NO: 9541 - DNA, 22 bp, Artificial Sequence
  Description of Artificial Sequence: Synthetic oligonucleotide
cggactctaattagagtccgtg

SEQ ID NO: 9542 - DNA, 22 bp, Artificial Sequence
  Description of Artificial Sequence: Synthetic oligonucleotide
cagactctaattagagtctggg

SEQ ID NO: 9543 - DNA, 22 bp, Artificial Sequence
  Description of Artificial Sequence: Synthetic oligonucleotide
cggactctaattagagtccgag

SEQ ID NO: 9544 - DNA, 22 bp, Artificial Sequence
  Description of Artificial Sequence: Synthetic oligonucleotide
ctgactctaattagagtcaggg

SEQ ID NO: 9545 - DNA, 22 bp, Artificial Sequence
  Description of Artificial Sequence: Synthetic oligonucleotide
acgactctaattagagtcgtgg

SEQ ID NO: 9546 - DNA, 22 bp, Artificial Sequence
  Description of Artificial Sequence: Synthetic oligonucleotide
ccgactctaattagagtcggct

SEQ ID NO: 9547 - DNA, 22 bp, Artificial Sequence
  Description of Artificial Sequence: Synthetic oligonucleotide
ccgactctaattagagtcggca

SEQ ID NO: 9548 - DNA, 22 bp, Artificial Sequence
  Description of Artificial Sequence: Synthetic oligonucleotide
gagactctaattagagtctcgc

SEQ ID NO: 9549 - DNA, 22 bp, Artificial Sequence
  Description of Artificial Sequence: Synthetic oligonucleotide
gtgactctaattagagtcacgc

SEQ ID NO: 9550 - DNA, 22 bp, Artificial Sequence
  Description of Artificial Sequence: Synthetic oligonucleotide
aggactctaattagagtcctgc

SEQ ID NO: 9551 - DNA, 22 bp, Artificial Sequence
  Description of Artificial Sequence: Synthetic oligonucleotide
tggactctaattagagtccagc

SEQ ID NO: 9552 - DNA, 22 bp, Artificial Sequence
  Description of Artificial Sequence: Synthetic oligonucleotide
aggactctaattagagtcctcg

SEQ ID NO: 9553 - DNA, 22 bp, Artificial Sequence
  Description of Artificial Sequence: Synthetic oligonucleotide
tggactctaattagagtccacg

SEQ ID NO: 9554 - DNA, 22 bp, Artificial Sequence
  Description of Artificial Sequence: Synthetic oligonucleotide
ccgactctaattagagtcggtg

SEQ ID NO: 9555 - DNA, 22 bp, Artificial Sequence
  Description of Artificial Sequence: Synthetic oligonucleotide
ccgactctaattagagtcggag

SEQ ID NO: 9556 - DNA, 22 bp, Artificial Sequence
  Description of Artificial Sequence: Synthetic oligonucleotide
gggactctaattagagtcccgc

SEQ ID NO: 9557 - DNA, 22 bp, Artificial Sequence
  Description of Artificial Sequence: Synthetic oligonucleotide
gggactctaattagagtccctc

SEQ ID NO: 9558 - DNA, 22 bp, Artificial Sequence
  Description of Artificial Sequence: Synthetic oligonucleotide
gggactctaattagagtcccac

SEQ ID NO: 9559 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctatatagagtcnnnn

SEQ ID NO: 9560 - DNA, 22 bp, Artificial Sequence
  Description of Artificial Sequence: Synthetic oligonucleotide
cggactctatatagagtccgcc

SEQ ID NO: 9561 - DNA, 22 bp, Artificial Sequence
  Description of Artificial Sequence: Synthetic oligonucleotide
cggactctatatagagtccgct

SEQ ID NO: 9562 - DNA, 22 bp, Artificial Sequence
  Description of Artificial Sequence: Synthetic oligonucleotide
cggactctatatagagtccgtc

SEQ ID NO: 9563 - DNA, 22 bp, Artificial Sequence
  Description of Artificial Sequence: Synthetic oligonucleotide
aggactctatatagagtcctcc

SEQ ID NO: 9564 - DNA, 22 bp, Artificial Sequence
  Description of Artificial Sequence: Synthetic oligonucleotide
cagactctatatagagtctgcc

SEQ ID NO: 9565 - DNA, 22 bp, Artificial Sequence
  Description of Artificial Sequence: Synthetic oligonucleotide
cggactctatatagagtccgca

SEQ ID NO: 9566 - DNA, 22 bp, Artificial Sequence
  Description of Artificial Sequence: Synthetic oligonucleotide
cggactctatatagagtccgac

SEQ ID NO: 9567 - DNA, 22 bp, Artificial Sequence
  Description of Artificial Sequence: Synthetic oligonucleotide
tggactctatatagagtccacc

SEQ ID NO: 9568 - DNA, 22 bp, Artificial Sequence
  Description of Artificial Sequence: Synthetic oligonucleotide
ctgactctatatagagtcagcc

SEQ ID NO: 9569 - DNA, 22 bp, Artificial Sequence
  Description of Artificial Sequence: Synthetic oligonucleotide
ccgactctatatagagtcgggc

SEQ ID NO: 9570 - DNA, 22 bp, Artificial Sequence
  Description of Artificial Sequence: Synthetic oligonucleotide
ccgactctatatagagtcgggt

SEQ ID NO: 9571 - DNA, 22 bp, Artificial Sequence
  Description of Artificial Sequence: Synthetic oligonucleotide
ccgactctatatagagtcggtc

SEQ ID NO: 9572 - DNA, 22 bp, Artificial Sequence
  Description of Artificial Sequence: Synthetic oligonucleotide
acgactctatatagagtcgtgc

SEQ ID NO: 9573 - DNA, 22 bp, Artificial Sequence
  Description of Artificial Sequence: Synthetic oligonucleotide
cagactctatatagagtctggc

SEQ ID NO: 9574 - DNA, 22 bp, Artificial Sequence
  Description of Artificial Sequence: Synthetic oligonucleotide
ccgactctatatagagtcggga

SEQ ID NO: 9575 - DNA, 22 bp, Artificial Sequence
  Description of Artificial Sequence: Synthetic oligonucleotide
ccgactctatatagagtcggac

SEQ ID NO: 9576 - DNA, 22 bp, Artificial Sequence
  Description of Artificial Sequence: Synthetic oligonucleotide
ctgactctatatagagtcaggc

SEQ ID NO: 9577 - DNA, 22 bp, Artificial Sequence
  Description of Artificial Sequence: Synthetic oligonucleotide
gcgactctatatagagtcgccc

SEQ ID NO: 9578 - DNA, 22 bp, Artificial Sequence
  Description of Artificial Sequence: Synthetic oligonucleotide
gcgactctatatagagtcgcct

SEQ ID NO: 9579 - DNA, 22 bp, Artificial Sequence
  Description of Artificial Sequence: Synthetic oligonucleotide
gcgactctatatagagtcgctc

SEQ ID NO: 9580 - DNA, 22 bp, Artificial Sequence
  Description of Artificial Sequence: Synthetic oligonucleotide
acgactctatatagagtcgtcc

SEQ ID NO: 9581 - DNA, 22 bp, Artificial Sequence
  Description of Artificial Sequence: Synthetic oligonucleotide
gagactctatatagagtctccc

SEQ ID NO: 9582 - DNA, 22 bp, Artificial Sequence
  Description of Artificial Sequence: Synthetic oligonucleotide
gcgactctatatagagtcgcca

SEQ ID NO: 9583 - DNA, 22 bp, Artificial Sequence
  Description of Artificial Sequence: Synthetic oligonucleotide
gcgactctatatagagtcgcac

SEQ ID NO: 9584 - DNA, 22 bp, Artificial Sequence
  Description of Artificial Sequence: Synthetic oligonucleotide
gtgactctatatagagtcaccc

SEQ ID NO: 9585 - DNA, 22 bp, Artificial Sequence
  Description of Artificial Sequence: Synthetic oligonucleotide
gggactctatatagagtcccgt

SEQ ID NO: 9586 - DNA, 22 bp, Artificial Sequence
  Description of Artificial Sequence: Synthetic oligonucleotide
gggactctatatagagtccctg

SEQ ID NO: 9587 - DNA, 22 bp, Artificial Sequence
  Description of Artificial Sequence: Synthetic oligonucleotide
aggactctatatagagtcctgg

SEQ ID NO: 9588 - DNA, 22 bp, Artificial Sequence
  Description of Artificial Sequence: Synthetic oligonucleotide
gagactctatatagagtctcgg

SEQ ID NO: 9589 - DNA, 22 bp, Artificial Sequence
  Description of Artificial Sequence: Synthetic oligonucleotide
gggactctatatagagtcccga

SEQ ID NO: 9590 - DNA, 22 bp, Artificial Sequence
  Description of Artificial Sequence: Synthetic oligonucleotide
gggactctatatagagtcccag

SEQ ID NO: 9591 - DNA, 22 bp, Artificial Sequence
  Description of Artificial Sequence: Synthetic oligonucleotide
tggactctatatagagtccagg

SEQ ID NO: 9592 - DNA, 22 bp, Artificial Sequence
  Description of Artificial Sequence: Synthetic oligonucleotide
gtgactctatatagagtcacgg

SEQ ID NO: 9593 - DNA, 22 bp, Artificial Sequence
  Description of Artificial Sequence: Synthetic oligonucleotide
gcgactctatatagagtcgccg

SEQ ID NO: 9594 - DNA, 22 bp, Artificial Sequence
  Description of Artificial Sequence: Synthetic oligonucleotide
gcgactctatatagagtcgctg

SEQ ID NO: 9595 - DNA, 22 bp, Artificial Sequence
  Description of Artificial Sequence: Synthetic oligonucleotide
acgactctatatagagtcgtcg

SEQ ID NO: 9596 - DNA, 22 bp, Artificial Sequence
  Description of Artificial Sequence: Synthetic oligonucleotide
gagactctatatagagtctccg

SEQ ID NO: 9597 - DNA, 22 bp, Artificial Sequence
  Description of Artificial Sequence: Synthetic oligonucleotide
gcgactctatatagagtcgcag

SEQ ID NO: 9598 - DNA, 22 bp, Artificial Sequence
  Description of Artificial Sequence: Synthetic oligonucleotide
gtgactctatatagagtcaccg

SEQ ID NO: 9599 - DNA, 22 bp, Artificial Sequence
  Description of Artificial Sequence: Synthetic oligonucleotide
cggactctatatagagtccgtg

SEQ ID NO: 9600 - DNA, 22 bp, Artificial Sequence
  Description of Artificial Sequence: Synthetic oligonucleotide
cagactctatatagagtctggg

SEQ ID NO: 9601 - DNA, 22 bp, Artificial Sequence
  Description of Artificial Sequence: Synthetic oligonucleotide
cggactctatatagagtccgag

SEQ ID NO: 9602 - DNA, 22 bp, Artificial Sequence
  Description of Artificial Sequence: Synthetic oligonucleotide
ctgactctatatagagtcaggg

SEQ ID NO: 9603 - DNA, 22 bp, Artificial Sequence
  Description of Artificial Sequence: Synthetic oligonucleotide
acgactctatatagagtcgtgg

SEQ ID NO: 9604 - DNA, 22 bp, Artificial Sequence
  Description of Artificial Sequence: Synthetic oligonucleotide
ccgactctatatagagtcggct

SEQ ID NO: 9605 - DNA, 22 bp, Artificial Sequence
  Description of Artificial Sequence: Synthetic oligonucleotide
ccgactctatatagagtcggca

SEQ ID NO: 9606 - DNA, 22 bp, Artificial Sequence
  Description of Artificial Sequence: Synthetic oligonucleotide
gagactctatatagagtctcgc

SEQ ID NO: 9607 - DNA, 22 bp, Artificial Sequence
  Description of Artificial Sequence: Synthetic oligonucleotide
gtgactctatatagagtcacgc

SEQ ID NO: 9608 - DNA, 22 bp, Artificial Sequence
  Description of Artificial Sequence: Synthetic oligonucleotide
aggactctatatagagtcctgc

SEQ ID NO: 9609 - DNA, 22 bp, Artificial Sequence
  Description of Artificial Sequence: Synthetic oligonucleotide
tggactctatatagagtccagc

SEQ ID NO: 9610 - DNA, 22 bp, Artificial Sequence
  Description of Artificial Sequence: Synthetic oligonucleotide
aggactctatatagagtcctcg

SEQ ID NO: 9611 - DNA, 22 bp, Artificial Sequence
  Description of Artificial Sequence: Synthetic oligonucleotide
tggactctatatagagtccacg

SEQ ID NO: 9612 - DNA, 22 bp, Artificial Sequence
  Description of Artificial Sequence: Synthetic oligonucleotide
ccgactctatatagagtcggtg

SEQ ID NO: 9613 - DNA, 22 bp, Artificial Sequence
  Description of Artificial Sequence: Synthetic oligonucleotide
ccgactctatatagagtcggag

SEQ ID NO: 9614 - DNA, 22 bp, Artificial Sequence
  Description of Artificial Sequence: Synthetic oligonucleotide
gggactctatatagagtcccgc

SEQ ID NO: 9615 - DNA, 22 bp, Artificial Sequence
  Description of Artificial Sequence: Synthetic oligonucleotide
gggactctatatagagtccctc

SEQ ID NO: 9616 - DNA, 22 bp, Artificial Sequence
  Description of Artificial Sequence: Synthetic oligonucleotide
gggactctatatagagtcccac

SEQ ID NO: 9617 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctagctagagtcnnnn

SEQ ID NO: 9618 - DNA, 22 bp, Artificial Sequence
  Description of Artificial Sequence: Synthetic oligonucleotide
cggactctagctagagtccgcc

SEQ ID NO: 9619 - DNA, 22 bp, Artificial Sequence
  Description of Artificial Sequence: Synthetic oligonucleotide
cggactctagctagagtccgct

SEQ ID NO: 9620 - DNA, 22 bp, Artificial Sequence
  Description of Artificial Sequence: Synthetic oligonucleotide
cggactctagctagagtccgtc

SEQ ID NO: 9621 - DNA, 22 bp, Artificial Sequence
  Description of Artificial Sequence: Synthetic oligonucleotide
aggactctagctagagtcctcc

SEQ ID NO: 9622 - DNA, 22 bp, Artificial Sequence
  Description of Artificial Sequence: Synthetic oligonucleotide
cagactctagctagagtctgcc

SEQ ID NO: 9623 - DNA, 22 bp, Artificial Sequence
  Description of Artificial Sequence: Synthetic oligonucleotide
cggactctagctagagtccgca

SEQ ID NO: 9624 - DNA, 22 bp, Artificial Sequence
  Description of Artificial Sequence: Synthetic oligonucleotide
cggactctagctagagtccgac

SEQ ID NO: 9625 - DNA, 22 bp, Artificial Sequence
  Description of Artificial Sequence: Synthetic oligonucleotide
tggactctagctagagtccacc

SEQ ID NO: 9626 - DNA, 22 bp, Artificial Sequence
  Description of Artificial Sequence: Synthetic oligonucleotide
ctgactctagctagagtcagcc

SEQ ID NO: 9627 - DNA, 22 bp, Artificial Sequence
  Description of Artificial Sequence: Synthetic oligonucleotide
ccgactctagctagagtcgggc

SEQ ID NO: 9628 - DNA, 22 bp, Artificial Sequence
  Description of Artificial Sequence: Synthetic oligonucleotide
ccgactctagctagagtcgggt

SEQ ID NO: 9629 - DNA, 22 bp, Artificial Sequence
  Description of Artificial Sequence: Synthetic oligonucleotide
ccgactctagctagagtcggtc

SEQ ID NO: 9630 - DNA, 22 bp, Artificial Sequence
  Description of Artificial Sequence: Synthetic oligonucleotide
acgactctagctagagtcgtgc

SEQ ID NO: 9631 - DNA, 22 bp, Artificial Sequence
  Description of Artificial Sequence: Synthetic oligonucleotide
cagactctagctagagtctggc

SEQ ID NO: 9632 - DNA, 22 bp, Artificial Sequence
  Description of Artificial Sequence: Synthetic oligonucleotide
ccgactctagctagagtcggga

SEQ ID NO: 9633 - DNA, 22 bp, Artificial Sequence
  Description of Artificial Sequence: Synthetic oligonucleotide
ccgactctagctagagtcggac

SEQ ID NO: 9634 - DNA, 22 bp, Artificial Sequence
  Description of Artificial Sequence: Synthetic oligonucleotide
ctgactctagctagagtcaggc

SEQ ID NO: 9635 - DNA, 22 bp, Artificial Sequence
  Description of Artificial Sequence: Synthetic oligonucleotide
gcgactctagctagagtcgccc

SEQ ID NO: 9636 - DNA, 22 bp, Artificial Sequence
  Description of Artificial Sequence: Synthetic oligonucleotide
gcgactctagctagagtcgcct

SEQ ID NO: 9637 - DNA, 22 bp, Artificial Sequence
  Description of Artificial Sequence: Synthetic oligonucleotide
gcgactctagctagagtcgctc

SEQ ID NO: 9638 - DNA, 22 bp, Artificial Sequence
  Description of Artificial Sequence: Synthetic oligonucleotide
acgactctagctagagtcgtcc

SEQ ID NO: 9639 - DNA, 22 bp, Artificial Sequence
  Description of Artificial Sequence: Synthetic oligonucleotide
gagactctagctagagtctccc

SEQ ID NO: 9640 - DNA, 22 bp, Artificial Sequence
  Description of Artificial Sequence: Synthetic oligonucleotide
gcgactctagctagagtcgcca

SEQ ID NO: 9641 - DNA, 22 bp, Artificial Sequence
  Description of Artificial Sequence: Synthetic oligonucleotide
gcgactctagctagagtcgcac

SEQ ID NO: 9642 - DNA, 22 bp, Artificial Sequence
  Description of Artificial Sequence: Synthetic oligonucleotide
gtgactctagctagagtcaccc

SEQ ID NO: 9643 - DNA, 22 bp, Artificial Sequence
  Description of Artificial Sequence: Synthetic oligonucleotide
gggactctagctagagtcccgt

SEQ ID NO: 9644 - DNA, 22 bp, Artificial Sequence
  Description of Artificial Sequence: Synthetic oligonucleotide
gggactctagctagagtccctg

SEQ ID NO: 9645 - DNA, 22 bp, Artificial Sequence
  Description of Artificial Sequence: Synthetic oligonucleotide
aggactctagctagagtcctgg

SEQ ID NO: 9646 - DNA, 22 bp, Artificial Sequence
  Description of Artificial Sequence: Synthetic oligonucleotide
gagactctagctagagtctcgg

SEQ ID NO: 9647 - DNA, 22 bp, Artificial Sequence
  Description of Artificial Sequence: Synthetic oligonucleotide
gggactctagctagagtcccga

SEQ ID NO: 9648 - DNA, 22 bp, Artificial Sequence
  Description of Artificial Sequence: Synthetic oligonucleotide
gggactctagctagagtcccag

SEQ ID NO: 9649 - DNA, 22 bp, Artificial Sequence
  Description of Artificial Sequence: Synthetic oligonucleotide
tggactctagctagagtccagg

SEQ ID NO: 9650 - DNA, 22 bp, Artificial Sequence
  Description of Artificial Sequence: Synthetic oligonucleotide
gtgactctagctagagtcacgg

SEQ ID NO: 9651 - DNA, 22 bp, Artificial Sequence
  Description of Artificial Sequence: Synthetic oligonucleotide
gcgactctagctagagtcgccg

SEQ ID NO: 9652 - DNA, 22 bp, Artificial Sequence
  Description of Artificial Sequence: Synthetic oligonucleotide
gcgactctagctagagtcgctg

SEQ ID NO: 9653 - DNA, 22 bp, Artificial Sequence
  Description of Artificial Sequence: Synthetic oligonucleotide
acgactctagctagagtcgtcg

SEQ ID NO: 9654 - DNA, 22 bp, Artificial Sequence
  Description of Artificial Sequence: Synthetic oligonucleotide
gagactctagctagagtctccg

SEQ ID NO: 9655 - DNA, 22 bp, Artificial Sequence
  Description of Artificial Sequence: Synthetic oligonucleotide
gcgactctagctagagtcgcag

SEQ ID NO: 9656 - DNA, 22 bp, Artificial Sequence
  Description of Artificial Sequence: Synthetic oligonucleotide
gtgactctagctagagtcaccg

SEQ ID NO: 9657 - DNA, 22 bp, Artificial Sequence
  Description of Artificial Sequence: Synthetic oligonucleotide
cggactctagctagagtccgtg

SEQ ID NO: 9658 - DNA, 22 bp, Artificial Sequence
  Description of Artificial Sequence: Synthetic oligonucleotide
cagactctagctagagtctggg

SEQ ID NO: 9659 - DNA, 22 bp, Artificial Sequence
  Description of Artificial Sequence: Synthetic oligonucleotide
cggactctagctagagtccgag

SEQ ID NO: 9660 - DNA, 22 bp, Artificial Sequence
  Description of Artificial Sequence: Synthetic oligonucleotide
ctgactctagctagagtcaggg

SEQ ID NO: 9661 - DNA, 22 bp, Artificial Sequence
  Description of Artificial Sequence: Synthetic oligonucleotide
acgactctagctagagtcgtgg

SEQ ID NO: 9662 - DNA, 22 bp, Artificial Sequence
  Description of Artificial Sequence: Synthetic oligonucleotide
ccgactctagctagagtcggct

SEQ ID NO: 9663 - DNA, 22 bp, Artificial Sequence
  Description of Artificial Sequence: Synthetic oligonucleotide
ccgactctagctagagtcggca

SEQ ID NO: 9664 - DNA, 22 bp, Artificial Sequence
  Description of Artificial Sequence: Synthetic oligonucleotide
gagactctagctagagtctcgc

SEQ ID NO: 9665 - DNA, 22 bp, Artificial Sequence
  Description of Artificial Sequence: Synthetic oligonucleotide
gtgactctagctagagtcacgc

SEQ ID NO: 9666 - DNA, 22 bp, Artificial Sequence
  Description of Artificial Sequence: Synthetic oligonucleotide
aggactctagctagagtcctgc

SEQ ID NO: 9667 - DNA, 22 bp, Artificial Sequence
  Description of Artificial Sequence: Synthetic oligonucleotide
tggactctagctagagtccagc

SEQ ID NO: 9668 - DNA, 22 bp, Artificial Sequence
  Description of Artificial Sequence: Synthetic oligonucleotide
aggactctagctagagtcctcg

SEQ ID NO: 9669 - DNA, 22 bp, Artificial Sequence
  Description of Artificial Sequence: Synthetic oligonucleotide
tggactctagctagagtccacg

SEQ ID NO: 9670 - DNA, 22 bp, Artificial Sequence
  Description of Artificial Sequence: Synthetic oligonucleotide
ccgactctagctagagtcggtg

SEQ ID NO: 9671 - DNA, 22 bp, Artificial Sequence
  Description of Artificial Sequence: Synthetic oligonucleotide
ccgactctagctagagtcggag

SEQ ID NO: 9672 - DNA, 22 bp, Artificial Sequence
  Description of Artificial Sequence: Synthetic oligonucleotide
gggactctagctagagtcccgc

SEQ ID NO: 9673 - DNA, 22 bp, Artificial Sequence
  Description of Artificial Sequence: Synthetic oligonucleotide
gggactctagctagagtccctc

SEQ ID NO: 9674 - DNA, 22 bp, Artificial Sequence
  Description of Artificial Sequence: Synthetic oligonucleotide
gggactctagctagagtcccac

SEQ ID NO: 9675 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctacgtagagtcnnnn

SEQ ID NO: 9676 - DNA, 22 bp, Artificial Sequence
  Description of Artificial Sequence: Synthetic oligonucleotide
cggactctacgtagagtccgcc

SEQ ID NO: 9677 - DNA, 22 bp, Artificial Sequence
  Description of Artificial Sequence: Synthetic oligonucleotide
cggactctacgtagagtccgct

SEQ ID NO: 9678 - DNA, 22 bp, Artificial Sequence
  Description of Artificial Sequence: Synthetic oligonucleotide
cggactctacgtagagtccgtc

SEQ ID NO: 9679 - DNA, 22 bp, Artificial Sequence
  Description of Artificial Sequence: Synthetic oligonucleotide
aggactctacgtagagtcctcc

SEQ ID NO: 9680 - DNA, 22 bp, Artificial Sequence
  Description of Artificial Sequence: Synthetic oligonucleotide
cagactctacgtagagtctgcc

SEQ ID NO: 9681 - DNA, 22 bp, Artificial Sequence
  Description of Artificial Sequence: Synthetic oligonucleotide
cggactctacgtagagtccgca

SEQ ID NO: 9682 - DNA, 22 bp, Artificial Sequence
  Description of Artificial Sequence: Synthetic oligonucleotide
cggactctacgtagagtccgac

SEQ ID NO: 9683 - DNA, 22 bp, Artificial Sequence
  Description of Artificial Sequence: Synthetic oligonucleotide
tggactctacgtagagtccacc

SEQ ID NO: 9684 - DNA, 22 bp, Artificial Sequence
  Description of Artificial Sequence: Synthetic oligonucleotide
ctgactctacgtagagtcagcc

SEQ ID NO: 9685 - DNA, 22 bp, Artificial Sequence
  Description of Artificial Sequence: Synthetic oligonucleotide
ccgactctacgtagagtcgggc

SEQ ID NO: 9686 - DNA, 22 bp, Artificial Sequence
  Description of Artificial Sequence: Synthetic oligonucleotide
ccgactctacgtagagtcgggt

SEQ ID NO: 9687 - DNA, 22 bp, Artificial Sequence
  Description of Artificial Sequence: Synthetic oligonucleotide
ccgactctacgtagagtcggtc

SEQ ID NO: 9688 - DNA, 22 bp, Artificial Sequence
  Description of Artificial Sequence: Synthetic oligonucleotide
acgactctacgtagagtcgtgc

SEQ ID NO: 9689 - DNA, 22 bp, Artificial Sequence
  Description of Artificial Sequence: Synthetic oligonucleotide
cagactctacgtagagtctggc

SEQ ID NO: 9690 - DNA, 22 bp, Artificial Sequence
  Description of Artificial Sequence: Synthetic oligonucleotide
ccgactctacgtagagtcggga

SEQ ID NO: 9691 - DNA, 22 bp, Artificial Sequence
  Description of Artificial Sequence: Synthetic oligonucleotide
ccgactctacgtagagtcggac

SEQ ID NO: 9692 - DNA, 22 bp, Artificial Sequence
  Description of Artificial Sequence: Synthetic oligonucleotide
ctgactctacgtagagtcaggc

SEQ ID NO: 9693 - DNA, 22 bp, Artificial Sequence
  Description of Artificial Sequence: Synthetic oligonucleotide
gcgactctacgtagagtcgccc

SEQ ID NO: 9694 - DNA, 22 bp, Artificial Sequence
  Description of Artificial Sequence: Synthetic oligonucleotide
gcgactctacgtagagtcgcct

SEQ ID NO: 9695 - DNA, 22 bp, Artificial Sequence
  Description of Artificial Sequence: Synthetic oligonucleotide
gcgactctacgtagagtcgctc

SEQ ID NO: 9696 - DNA, 22 bp, Artificial Sequence
  Description of Artificial Sequence: Synthetic oligonucleotide
acgactctacgtagagtcgtcc

SEQ ID NO: 9697 - DNA, 22 bp, Artificial Sequence
  Description of Artificial Sequence: Synthetic oligonucleotide
gagactctacgtagagtctccc

SEQ ID NO: 9698 - DNA, 22 bp, Artificial Sequence
  Description of Artificial Sequence: Synthetic oligonucleotide
gcgactctacgtagagtcgcca

SEQ ID NO: 9699 - DNA, 22 bp, Artificial Sequence
  Description of Artificial Sequence: Synthetic oligonucleotide
gcgactctacgtagagtcgcac

SEQ ID NO: 9700 - DNA, 22 bp, Artificial Sequence
  Description of Artificial Sequence: Synthetic oligonucleotide
gtgactctacgtagagtcaccc

SEQ ID NO: 9701 - DNA, 22 bp, Artificial Sequence
  Description of Artificial Sequence: Synthetic oligonucleotide
gggactctacgtagagtcccgt

SEQ ID NO: 9702 - DNA, 22 bp, Artificial Sequence
  Description of Artificial Sequence: Synthetic oligonucleotide
gggactctacgtagagtccctg

SEQ ID NO: 9703 - DNA, 22 bp, Artificial Sequence
  Description of Artificial Sequence: Synthetic oligonucleotide
aggactctacgtagagtcctgg

SEQ ID NO: 9704 - DNA, 22 bp, Artificial Sequence
  Description of Artificial Sequence: Synthetic oligonucleotide
gagactctacgtagagtctcgg

SEQ ID NO: 9705 - DNA, 22 bp, Artificial Sequence
  Description of Artificial Sequence: Synthetic oligonucleotide
gggactctacgtagagtcccga

SEQ ID NO: 9706 - DNA, 22 bp, Artificial Sequence
  Description of Artificial Sequence: Synthetic oligonucleotide
gggactctacgtagagtcccag

SEQ ID NO: 9707 - DNA, 22 bp, Artificial Sequence
  Description of Artificial Sequence: Synthetic oligonucleotide
tggactctacgtagagtccagg

SEQ ID NO: 9708 - DNA, 22 bp, Artificial Sequence
  Description of Artificial Sequence: Synthetic oligonucleotide
gtgactctacgtagagtcacgg

SEQ ID NO: 9709 - DNA, 22 bp, Artificial Sequence
  Description of Artificial Sequence: Synthetic oligonucleotide
gcgactctacgtagagtcgccg

SEQ ID NO: 9710 - DNA, 22 bp, Artificial Sequence
  Description of Artificial Sequence: Synthetic oligonucleotide
gcgactctacgtagagtcgctg

SEQ ID NO: 9711 - DNA, 22 bp, Artificial Sequence
  Description of Artificial Sequence: Synthetic oligonucleotide
acgactctacgtagagtcgtcg

SEQ ID NO: 9712 - DNA, 22 bp, Artificial Sequence
  Description of Artificial Sequence: Synthetic oligonucleotide
gagactctacgtagagtctccg

SEQ ID NO: 9713 - DNA, 22 bp, Artificial Sequence
  Description of Artificial Sequence: Synthetic oligonucleotide
gcgactctacgtagagtcgcag

SEQ ID NO: 9714 - DNA, 22 bp, Artificial Sequence
  Description of Artificial Sequence: Synthetic oligonucleotide
gtgactctacgtagagtcaccg

SEQ ID NO: 9715 - DNA, 22 bp, Artificial Sequence
  Description of Artificial Sequence: Synthetic oligonucleotide
cggactctacgtagagtccgtg

SEQ ID NO: 9716 - DNA, 22 bp, Artificial Sequence
  Description of Artificial Sequence: Synthetic oligonucleotide
cagactctacgtagagtctggg

SEQ ID NO: 9717 - DNA, 22 bp, Artificial Sequence
  Description of Artificial Sequence: Synthetic oligonucleotide
cggactctacgtagagtccgag

SEQ ID NO: 9718 - DNA, 22 bp, Artificial Sequence
  Description of Artificial Sequence: Synthetic oligonucleotide
ctgactctacgtagagtcaggg

SEQ ID NO: 9719 - DNA, 22 bp, Artificial Sequence
  Description of Artificial Sequence: Synthetic oligonucleotide
acgactctacgtagagtcgtgg

SEQ ID NO: 9720 - DNA, 22 bp, Artificial Sequence
  Description of Artificial Sequence: Synthetic oligonucleotide
ccgactctacgtagagtcggct

SEQ ID NO: 9721 - DNA, 22 bp, Artificial Sequence
  Description of Artificial Sequence: Synthetic oligonucleotide
ccgactctacgtagagtcggca

SEQ ID NO: 9722 - DNA, 22 bp, Artificial Sequence
  Description of Artificial Sequence: Synthetic oligonucleotide
gagactctacgtagagtctcgc

SEQ ID NO: 9723 - DNA, 22 bp, Artificial Sequence
  Description of Artificial Sequence: Synthetic oligonucleotide
gtgactctacgtagagtcacgc

SEQ ID NO: 9724 - DNA, 22 bp, Artificial Sequence
  Description of Artificial Sequence: Synthetic oligonucleotide
aggactctacgtagagtcctgc

SEQ ID NO: 9725 - DNA, 22 bp, Artificial Sequence
  Description of Artificial Sequence: Synthetic oligonucleotide
tggactctacgtagagtccagc

SEQ ID NO: 9726 - DNA, 22 bp, Artificial Sequence
  Description of Artificial Sequence: Synthetic oligonucleotide
aggactctacgtagagtcctcg

SEQ ID NO: 9727 - DNA, 22 bp, Artificial Sequence
  Description of Artificial Sequence: Synthetic oligonucleotide
tggactctacgtagagtccacg

SEQ ID NO: 9728 - DNA, 22 bp, Artificial Sequence
  Description of Artificial Sequence: Synthetic oligonucleotide
ccgactctacgtagagtcggtg

SEQ ID NO: 9729 - DNA, 22 bp, Artificial Sequence
  Description of Artificial Sequence: Synthetic oligonucleotide
ccgactctacgtagagtcggag

SEQ ID NO: 9730 - DNA, 22 bp, Artificial Sequence
  Description of Artificial Sequence: Synthetic oligonucleotide
gggactctacgtagagtcccgc

SEQ ID NO: 9731 - DNA, 22 bp, Artificial Sequence
  Description of Artificial Sequence: Synthetic oligonucleotide
gggactctacgtagagtccctc

SEQ ID NO: 9732 - DNA, 22 bp, Artificial Sequence
  Description of Artificial Sequence: Synthetic oligonucleotide
gggactctacgtagagtcccac

SEQ ID NO: 9733 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcatatatgagtcnnnn

SEQ ID NO: 9734 - DNA, 22 bp, Artificial Sequence
  Description of Artificial Sequence: Synthetic oligonucleotide
cggactcatatatgagtccgcc

SEQ ID NO: 9735 - DNA, 22 bp, Artificial Sequence
  Description of Artificial Sequence: Synthetic oligonucleotide
cggactcatatatgagtccgct

SEQ ID NO: 9736 - DNA, 22 bp, Artificial Sequence
  Description of Artificial Sequence: Synthetic oligonucleotide
cggactcatatatgagtccgtc

SEQ ID NO: 9737 - DNA, 22 bp, Artificial Sequence
  Description of Artificial Sequence: Synthetic oligonucleotide
aggactcatatatgagtcctcc

SEQ ID NO: 9738 - DNA, 22 bp, Artificial Sequence
  Description of Artificial Sequence: Synthetic oligonucleotide
cagactcatatatgagtctgcc

SEQ ID NO: 9739 - DNA, 22 bp, Artificial Sequence
  Description of Artificial Sequence: Synthetic oligonucleotide
cggactcatatatgagtccgca

SEQ ID NO: 9740 - DNA, 22 bp, Artificial Sequence
  Description of Artificial Sequence: Synthetic oligonucleotide
cggactcatatatgagtccgac

SEQ ID NO: 9741 - DNA, 22 bp, Artificial Sequence
  Description of Artificial Sequence: Synthetic oligonucleotide
tggactcatatatgagtccacc

SEQ ID NO: 9742 - DNA, 22 bp, Artificial Sequence
  Description of Artificial Sequence: Synthetic oligonucleotide
ctgactcatatatgagtcagcc

SEQ ID NO: 9743 - DNA, 22 bp, Artificial Sequence
  Description of Artificial Sequence: Synthetic oligonucleotide
ccgactcatatatgagtcgggc

SEQ ID NO: 9744 - DNA, 22 bp, Artificial Sequence
  Description of Artificial Sequence: Synthetic oligonucleotide
ccgactcatatatgagtcgggt

SEQ ID NO: 9745 - DNA, 22 bp, Artificial Sequence
  Description of Artificial Sequence: Synthetic oligonucleotide
ccgactcatatatgagtcggtc

SEQ ID NO: 9746 - DNA, 22 bp, Artificial Sequence
  Description of Artificial Sequence: Synthetic oligonucleotide
acgactcatatatgagtcgtgc

SEQ ID NO: 9747 - DNA, 22 bp, Artificial Sequence
  Description of Artificial Sequence: Synthetic oligonucleotide
cagactcatatatgagtctggc

SEQ ID NO: 9748 - DNA, 22 bp, Artificial Sequence
  Description of Artificial Sequence: Synthetic oligonucleotide
ccgactcatatatgagtcggga

SEQ ID NO: 9749 - DNA, 22 bp, Artificial Sequence
  Description of Artificial Sequence: Synthetic oligonucleotide
ccgactcatatatgagtcggac

SEQ ID NO: 9750 - DNA, 22 bp, Artificial Sequence
  Description of Artificial Sequence: Synthetic oligonucleotide
ctgactcatatatgagtcaggc

SEQ ID NO: 9751 - DNA, 22 bp, Artificial Sequence
  Description of Artificial Sequence: Synthetic oligonucleotide
gcgactcatatatgagtcgccc

SEQ ID NO: 9752 - DNA, 22 bp, Artificial Sequence
  Description of Artificial Sequence: Synthetic oligonucleotide
gcgactcatatatgagtcgcct

SEQ ID NO: 9753 - DNA, 22 bp, Artificial Sequence
  Description of Artificial Sequence: Synthetic oligonucleotide
gcgactcatatatgagtcgctc

SEQ ID NO: 9754 - DNA, 22 bp, Artificial Sequence
  Description of Artificial Sequence: Synthetic oligonucleotide
acgactcatatatgagtcgtcc

SEQ ID NO: 9755 - DNA, 22 bp, Artificial Sequence
  Description of Artificial Sequence: Synthetic oligonucleotide
gagactcatatatgagtctccc

SEQ ID NO: 9756 - DNA, 22 bp, Artificial Sequence
  Description of Artificial Sequence: Synthetic oligonucleotide
gcgactcatatatgagtcgcca

SEQ ID NO: 9757 - DNA, 22 bp, Artificial Sequence
  Description of Artificial Sequence: Synthetic oligonucleotide
gcgactcatatatgagtcgcac

SEQ ID NO: 9758 - DNA, 22 bp, Artificial Sequence
  Description of Artificial Sequence: Synthetic oligonucleotide
gtgactcatatatgagtcaccc

SEQ ID NO: 9759 - DNA, 22 bp, Artificial Sequence
  Description of Artificial Sequence: Synthetic oligonucleotide
gggactcatatatgagtcccgt

SEQ ID NO: 9760 - DNA, 22 bp, Artificial Sequence
  Description of Artificial Sequence: Synthetic oligonucleotide
gggactcatatatgagtccctg

SEQ ID NO: 9761 - DNA, 22 bp, Artificial Sequence
  Description of Artificial Sequence: Synthetic oligonucleotide
aggactcatatatgagtcctgg

SEQ ID NO: 9762 - DNA, 22 bp, Artificial Sequence
  Description of Artificial Sequence: Synthetic oligonucleotide
gagactcatatatgagtctcgg

SEQ ID NO: 9763 - DNA, 22 bp, Artificial Sequence
  Description of Artificial Sequence: Synthetic oligonucleotide
gggactcatatatgagtcccga

SEQ ID NO: 9764 - DNA, 22 bp, Artificial Sequence
  Description of Artificial Sequence: Synthetic oligonucleotide
gggactcatatatgagtcccag

SEQ ID NO: 9765 - DNA, 22 bp, Artificial Sequence
  Description of Artificial Sequence: Synthetic oligonucleotide
tggactcatatatgagtccagg

SEQ ID NO: 9766 - DNA, 22 bp, Artificial Sequence
  Description of Artificial Sequence: Synthetic oligonucleotide
gtgactcatatatgagtcacgg

SEQ ID NO: 9767 - DNA, 22 bp, Artificial Sequence
  Description of Artificial Sequence: Synthetic oligonucleotide
gcgactcatatatgagtcgccg

SEQ ID NO: 9768 - DNA, 22 bp, Artificial Sequence
  Description of Artificial Sequence: Synthetic oligonucleotide
gcgactcatatatgagtcgctg

SEQ ID NO: 9769 - DNA, 22 bp, Artificial Sequence
  Description of Artificial Sequence: Synthetic oligonucleotide
acgactcatatatgagtcgtcg

SEQ ID NO: 9770 - DNA, 22 bp, Artificial Sequence
  Description of Artificial Sequence: Synthetic oligonucleotide
gagactcatatatgagtctccg

SEQ ID NO: 9771 - DNA, 22 bp, Artificial Sequence
  Description of Artificial Sequence: Synthetic oligonucleotide
gcgactcatatatgagtcgcag

SEQ ID NO: 9772 - DNA, 22 bp, Artificial Sequence
  Description of Artificial Sequence: Synthetic oligonucleotide
gtgactcatatatgagtcaccg

SEQ ID NO: 9773 - DNA, 22 bp, Artificial Sequence
  Description of Artificial Sequence: Synthetic oligonucleotide
cggactcatatatgagtccgtg

SEQ ID NO: 9774 - DNA, 22 bp, Artificial Sequence
  Description of Artificial Sequence: Synthetic oligonucleotide
cagactcatatatgagtctggg

SEQ ID NO: 9775 - DNA, 22 bp, Artificial Sequence
  Description of Artificial Sequence: Synthetic oligonucleotide
cggactcatatatgagtccgag

SEQ ID NO: 9776 - DNA, 22 bp, Artificial Sequence
  Description of Artificial Sequence: Synthetic oligonucleotide
ctgactcatatatgagtcaggg

SEQ ID NO: 9777 - DNA, 22 bp, Artificial Sequence
  Description of Artificial Sequence: Synthetic oligonucleotide
acgactcatatatgagtcgtgg

SEQ ID NO: 9778 - DNA, 22 bp, Artificial Sequence
  Description of Artificial Sequence: Synthetic oligonucleotide
ccgactcatatatgagtcggct

SEQ ID NO: 9779 - DNA, 22 bp, Artificial Sequence
  Description of Artificial Sequence: Synthetic oligonucleotide
ccgactcatatatgagtcggca

SEQ ID NO: 9780 - DNA, 22 bp, Artificial Sequence
  Description of Artificial Sequence: Synthetic oligonucleotide
gagactcatatatgagtctcgc

SEQ ID NO: 9781 - DNA, 22 bp, Artificial Sequence
  Description of Artificial Sequence: Synthetic oligonucleotide
gtgactcatatatgagtcacgc

SEQ ID NO: 9782 - DNA, 22 bp, Artificial Sequence
  Description of Artificial Sequence: Synthetic oligonucleotide
aggactcatatatgagtcctgc

SEQ ID NO: 9783 - DNA, 22 bp, Artificial Sequence
  Description of Artificial Sequence: Synthetic oligonucleotide
tggactcatatatgagtccagc

SEQ ID NO: 9784 - DNA, 22 bp, Artificial Sequence
  Description of Artificial Sequence: Synthetic oligonucleotide
aggactcatatatgagtcctcg

SEQ ID NO: 9785 - DNA, 22 bp, Artificial Sequence
  Description of Artificial Sequence: Synthetic oligonucleotide
tggactcatatatgagtccacg

SEQ ID NO: 9786 - DNA, 22 bp, Artificial Sequence
  Description of Artificial Sequence: Synthetic oligonucleotide
ccgactcatatatgagtcggtg

SEQ ID NO: 9787 - DNA, 22 bp, Artificial Sequence
  Description of Artificial Sequence: Synthetic oligonucleotide
ccgactcatatatgagtcggag

SEQ ID NO: 9788 - DNA, 22 bp, Artificial Sequence
  Description of Artificial Sequence: Synthetic oligonucleotide
gggactcatatatgagtcccgc

SEQ ID NO: 9789 - DNA, 22 bp, Artificial Sequence
  Description of Artificial Sequence: Synthetic oligonucleotide
gggactcatatatgagtccctc

SEQ ID NO: 9790 - DNA, 22 bp, Artificial Sequence
  Description of Artificial Sequence: Synthetic oligonucleotide
gggactcatatatgagtcccac

SEQ ID NO: 9791 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcattaatgagtcnnnn

SEQ ID NO: 9792 - DNA, 22 bp, Artificial Sequence
  Description of Artificial Sequence: Synthetic oligonucleotide
cggactcattaatgagtccgcc

SEQ ID NO: 9793 - DNA, 22 bp, Artificial Sequence
  Description of Artificial Sequence: Synthetic oligonucleotide
cggactcattaatgagtccgct

SEQ ID NO: 9794 - DNA, 22 bp, Artificial Sequence
  Description of Artificial Sequence: Synthetic oligonucleotide
cggactcattaatgagtccgtc

SEQ ID NO: 9795 - DNA, 22 bp, Artificial Sequence
  Description of Artificial Sequence: Synthetic oligonucleotide
aggactcattaatgagtcctcc

SEQ ID NO: 9796 - DNA, 22 bp, Artificial Sequence
  Description of Artificial Sequence: Synthetic oligonucleotide
cagactcattaatgagtctgcc

SEQ ID NO: 9797 - DNA, 22 bp, Artificial Sequence
  Description of Artificial Sequence: Synthetic oligonucleotide
cggactcattaatgagtccgca

SEQ ID NO: 9798 - DNA, 22 bp, Artificial Sequence
  Description of Artificial Sequence: Synthetic oligonucleotide
cggactcattaatgagtccgac

SEQ ID NO: 9799 - DNA, 22 bp, Artificial Sequence
  Description of Artificial Sequence: Synthetic oligonucleotide
tggactcattaatgagtccacc

SEQ ID NO: 9800 - DNA, 22 bp, Artificial Sequence
  Description of Artificial Sequence: Synthetic oligonucleotide
ctgactcattaatgagtcagcc

SEQ ID NO: 9801 - DNA, 22 bp, Artificial Sequence
  Description of Artificial Sequence: Synthetic oligonucleotide
ccgactcattaatgagtcgggc

SEQ ID NO: 9802 - DNA, 22 bp, Artificial Sequence
  Description of Artificial Sequence: Synthetic oligonucleotide
ccgactcattaatgagtcgggt

SEQ ID NO: 9803 - DNA, 22 bp, Artificial Sequence
  Description of Artificial Sequence: Synthetic oligonucleotide
ccgactcattaatgagtcggtc

SEQ ID NO: 9804 - DNA, 22 bp, Artificial Sequence
  Description of Artificial Sequence: Synthetic oligonucleotide
acgactcattaatgagtcgtgc

SEQ ID NO: 9805 - DNA, 22 bp, Artificial Sequence
  Description of Artificial Sequence: Synthetic oligonucleotide
cagactcattaatgagtctggc

SEQ ID NO: 9806 - DNA, 22 bp, Artificial Sequence
  Description of Artificial Sequence: Synthetic oligonucleotide
ccgactcattaatgagtcggga

SEQ ID NO: 9807 - DNA, 22 bp, Artificial Sequence
  Description of Artificial Sequence: Synthetic oligonucleotide
ccgactcattaatgagtcggac

SEQ ID NO: 9808 - DNA, 22 bp, Artificial Sequence
  Description of Artificial Sequence: Synthetic oligonucleotide
ctgactcattaatgagtcaggc

SEQ ID NO: 9809 - DNA, 22 bp, Artificial Sequence
  Description of Artificial Sequence: Synthetic oligonucleotide
gcgactcattaatgagtcgccc

SEQ ID NO: 9810 - DNA, 22 bp, Artificial Sequence
  Description of Artificial Sequence: Synthetic oligonucleotide
gcgactcattaatgagtcgcct

SEQ ID NO: 9811 - DNA, 22 bp, Artificial Sequence
  Description of Artificial Sequence: Synthetic oligonucleotide
gcgactcattaatgagtcgctc

SEQ ID NO: 9812 - DNA, 22 bp, Artificial Sequence
  Description of Artificial Sequence: Synthetic oligonucleotide
acgactcattaatgagtcgtcc

SEQ ID NO: 9813 - DNA, 22 bp, Artificial Sequence
  Description of Artificial Sequence: Synthetic oligonucleotide
gagactcattaatgagtctccc

SEQ ID NO: 9814 - DNA, 22 bp, Artificial Sequence
  Description of Artificial Sequence: Synthetic oligonucleotide
gcgactcattaatgagtcgcca

SEQ ID NO: 9815 - DNA, 22 bp, Artificial Sequence
  Description of Artificial Sequence: Synthetic oligonucleotide
gcgactcattaatgagtcgcac

SEQ ID NO: 9816 - DNA, 22 bp, Artificial Sequence
  Description of Artificial Sequence: Synthetic oligonucleotide
gtgactcattaatgagtcaccc

SEQ ID NO: 9817 - DNA, 22 bp, Artificial Sequence
  Description of Artificial Sequence: Synthetic oligonucleotide
gggactcattaatgagtcccgt

SEQ ID NO: 9818 - DNA, 22 bp, Artificial Sequence
  Description of Artificial Sequence: Synthetic oligonucleotide
gggactcattaatgagtccctg

SEQ ID NO: 9819 - DNA, 22 bp, Artificial Sequence
  Description of Artificial Sequence: Synthetic oligonucleotide
aggactcattaatgagtcctgg

SEQ ID NO: 9820 - DNA, 22 bp, Artificial Sequence
  Description of Artificial Sequence: Synthetic oligonucleotide
gagactcattaatgagtctcgg

SEQ ID NO: 9821 - DNA, 22 bp, Artificial Sequence
  Description of Artificial Sequence: Synthetic oligonucleotide
gggactcattaatgagtcccga

SEQ ID NO: 9822 - DNA, 22 bp, Artificial Sequence
  Description of Artificial Sequence: Synthetic oligonucleotide
gggactcattaatgagtcccag

SEQ ID NO: 9823 - DNA, 22 bp, Artificial Sequence
  Description of Artificial Sequence: Synthetic oligonucleotide
tggactcattaatgagtccagg

SEQ ID NO: 9824 - DNA, 22 bp, Artificial Sequence
  Description of Artificial Sequence: Synthetic oligonucleotide
gtgactcattaatgagtcacgg

SEQ ID NO: 9825 - DNA, 22 bp, Artificial Sequence
  Description of Artificial Sequence: Synthetic oligonucleotide
gcgactcattaatgagtcgccg

SEQ ID NO: 9826 - DNA, 22 bp, Artificial Sequence
  Description of Artificial Sequence: Synthetic oligonucleotide
gcgactcattaatgagtcgctg

SEQ ID NO: 9827 - DNA, 22 bp, Artificial Sequence
  Description of Artificial Sequence: Synthetic oligonucleotide
acgactcattaatgagtcgtcg

SEQ ID NO: 9828 - DNA, 22 bp, Artificial Sequence
  Description of Artificial Sequence: Synthetic oligonucleotide
gagactcattaatgagtctccg

SEQ ID NO: 9829 - DNA, 22 bp, Artificial Sequence
  Description of Artificial Sequence: Synthetic oligonucleotide
gcgactcattaatgagtcgcag

SEQ ID NO: 9830 - DNA, 22 bp, Artificial Sequence
  Description of Artificial Sequence: Synthetic oligonucleotide
gtgactcattaatgagtcaccg

SEQ ID NO: 9831 - DNA, 22 bp, Artificial Sequence
  Description of Artificial Sequence: Synthetic oligonucleotide
cggactcattaatgagtccgtg

SEQ ID NO: 9832 - DNA, 22 bp, Artificial Sequence
  Description of Artificial Sequence: Synthetic oligonucleotide
cagactcattaatgagtctggg

SEQ ID NO: 9833 - DNA, 22 bp, Artificial Sequence
  Description of Artificial Sequence: Synthetic oligonucleotide
cggactcattaatgagtccgag

SEQ ID NO: 9834 - DNA, 22 bp, Artificial Sequence
  Description of Artificial Sequence: Synthetic oligonucleotide
ctgactcattaatgagtcaggg

SEQ ID NO: 9835 - DNA, 22 bp, Artificial Sequence
  Description of Artificial Sequence: Synthetic oligonucleotide
acgactcattaatgagtcgtgg

SEQ ID NO: 9836 - DNA, 22 bp, Artificial Sequence
  Description of Artificial Sequence: Synthetic oligonucleotide
ccgactcattaatgagtcggct

SEQ ID NO: 9837 - DNA, 22 bp, Artificial Sequence
  Description of Artificial Sequence: Synthetic oligonucleotide
ccgactcattaatgagtcggca

SEQ ID NO: 9838 - DNA, 22 bp, Artificial Sequence
  Description of Artificial Sequence: Synthetic oligonucleotide
gagactcattaatgagtctcgc

SEQ ID NO: 9839 - DNA, 22 bp, Artificial Sequence
  Description of Artificial Sequence: Synthetic oligonucleotide
gtgactcattaatgagtcacgc

SEQ ID NO: 9840 - DNA, 22 bp, Artificial Sequence
  Description of Artificial Sequence: Synthetic oligonucleotide
aggactcattaatgagtcctgc

SEQ ID NO: 9841 - DNA, 22 bp, Artificial Sequence
  Description of Artificial Sequence: Synthetic oligonucleotide
tggactcattaatgagtccagc

SEQ ID NO: 9842 - DNA, 22 bp, Artificial Sequence
  Description of Artificial Sequence: Synthetic oligonucleotide
aggactcattaatgagtcctcg

SEQ ID NO: 9843 - DNA, 22 bp, Artificial Sequence
  Description of Artificial Sequence: Synthetic oligonucleotide
tggactcattaatgagtccacg

SEQ ID NO: 9844 - DNA, 22 bp, Artificial Sequence
  Description of Artificial Sequence: Synthetic oligonucleotide
ccgactcattaatgagtcggtg

SEQ ID NO: 9845 - DNA, 22 bp, Artificial Sequence
  Description of Artificial Sequence: Synthetic oligonucleotide
ccgactcattaatgagtcggag

SEQ ID NO: 9846 - DNA, 22 bp, Artificial Sequence
  Description of Artificial Sequence: Synthetic oligonucleotide
gggactcattaatgagtcccgc

SEQ ID NO: 9847 - DNA, 22 bp, Artificial Sequence
  Description of Artificial Sequence: Synthetic oligonucleotide
gggactcattaatgagtccctc

SEQ ID NO: 9848 - DNA, 22 bp, Artificial Sequence
  Description of Artificial Sequence: Synthetic oligonucleotide
gggactcattaatgagtcccac

SEQ ID NO: 9849 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcatgcatgagtcnnnn

SEQ ID NO: 9850 - DNA, 22 bp, Artificial Sequence
  Description of Artificial Sequence: Synthetic oligonucleotide
cggactcatgcatgagtccgcc

SEQ ID NO: 9851 - DNA, 22 bp, Artificial Sequence
  Description of Artificial Sequence: Synthetic oligonucleotide
cggactcatgcatgagtccgct

SEQ ID NO: 9852 - DNA, 22 bp, Artificial Sequence
  Description of Artificial Sequence: Synthetic oligonucleotide
cggactcatgcatgagtccgtc

SEQ ID NO: 9853 - DNA, 22 bp, Artificial Sequence
  Description of Artificial Sequence: Synthetic oligonucleotide
aggactcatgcatgagtcctcc

SEQ ID NO: 9854 - DNA, 22 bp, Artificial Sequence
  Description of Artificial Sequence: Synthetic oligonucleotide
cagactcatgcatgagtctgcc

SEQ ID NO: 9855 - DNA, 22 bp, Artificial Sequence
  Description of Artificial Sequence: Synthetic oligonucleotide
cggactcatgcatgagtccgca

SEQ ID NO: 9856 - DNA, 22 bp, Artificial Sequence
  Description of Artificial Sequence: Synthetic oligonucleotide
cggactcatgcatgagtccgac

SEQ ID NO: 9857 - DNA, 22 bp, Artificial Sequence
  Description of Artificial Sequence: Synthetic oligonucleotide
tggactcatgcatgagtccacc

SEQ ID NO: 9858 - DNA, 22 bp, Artificial Sequence
  Description of Artificial Sequence: Synthetic oligonucleotide
ctgactcatgcatgagtcagcc

SEQ ID NO: 9859 - DNA, 22 bp, Artificial Sequence
  Description of Artificial Sequence: Synthetic oligonucleotide
ccgactcatgcatgagtcgggc

SEQ ID NO: 9860 - DNA, 22 bp, Artificial Sequence
  Description of Artificial Sequence: Synthetic oligonucleotide
ccgactcatgcatgagtcgggt

SEQ ID NO: 9861 - DNA, 22 bp, Artificial Sequence
  Description of Artificial Sequence: Synthetic oligonucleotide
ccgactcatgcatgagtcggtc

SEQ ID NO: 9862 - DNA, 22 bp, Artificial Sequence
  Description of Artificial Sequence: Synthetic oligonucleotide
acgactcatgcatgagtcgtgc

SEQ ID NO: 9863 - DNA, 22 bp, Artificial Sequence
  Description of Artificial Sequence: Synthetic oligonucleotide
cagactcatgcatgagtctggc

SEQ ID NO: 9864 - DNA, 22 bp, Artificial Sequence
  Description of Artificial Sequence: Synthetic oligonucleotide
ccgactcatgcatgagtcggga

SEQ ID NO: 9865 - DNA, 22 bp, Artificial Sequence
  Description of Artificial Sequence: Synthetic oligonucleotide
ccgactcatgcatgagtcggac

SEQ ID NO: 9866 - DNA, 22 bp, Artificial Sequence
  Description of Artificial Sequence: Synthetic oligonucleotide
ctgactcatgcatgagtcaggc

SEQ ID NO: 9867 - DNA, 22 bp, Artificial Sequence
  Description of Artificial Sequence: Synthetic oligonucleotide
gcgactcatgcatgagtcgccc

SEQ ID NO: 9868 - DNA, 22 bp, Artificial Sequence
  Description of Artificial Sequence: Synthetic oligonucleotide
gcgactcatgcatgagtcgcct

SEQ ID NO: 9869 - DNA, 22 bp, Artificial Sequence
  Description of Artificial Sequence: Synthetic oligonucleotide
gcgactcatgcatgagtcgctc

SEQ ID NO: 9870 - DNA, 22 bp, Artificial Sequence
  Description of Artificial Sequence: Synthetic oligonucleotide
acgactcatgcatgagtcgtcc

SEQ ID NO: 9871 - DNA, 22 bp, Artificial Sequence
  Description of Artificial Sequence: Synthetic oligonucleotide
gagactcatgcatgagtctccc

SEQ ID NO: 9872 - DNA, 22 bp, Artificial Sequence
  Description of Artificial Sequence: Synthetic oligonucleotide
gcgactcatgcatgagtcgcca

SEQ ID NO: 9873 - DNA, 22 bp, Artificial Sequence
  Description of Artificial Sequence: Synthetic oligonucleotide
gcgactcatgcatgagtcgcac

SEQ ID NO: 9874 - DNA, 22 bp, Artificial Sequence
  Description of Artificial Sequence: Synthetic oligonucleotide
gtgactcatgcatgagtcaccc

SEQ ID NO: 9875 - DNA, 22 bp, Artificial Sequence
  Description of Artificial Sequence: Synthetic oligonucleotide
gggactcatgcatgagtcccgt

SEQ ID NO: 9876 - DNA, 22 bp, Artificial Sequence
  Description of Artificial Sequence: Synthetic oligonucleotide
gggactcatgcatgagtccctg

SEQ ID NO: 9877 - DNA, 22 bp, Artificial Sequence
  Description of Artificial Sequence: Synthetic oligonucleotide
aggactcatgcatgagtcctgg

SEQ ID NO: 9878 - DNA, 22 bp, Artificial Sequence
  Description of Artificial Sequence: Synthetic oligonucleotide
gagactcatgcatgagtctcgg

SEQ ID NO: 9879 - DNA, 22 bp, Artificial Sequence
  Description of Artificial Sequence: Synthetic oligonucleotide
gggactcatgcatgagtcccga

SEQ ID NO: 9880 - DNA, 22 bp, Artificial Sequence
  Description of Artificial Sequence: Synthetic oligonucleotide
gggactcatgcatgagtcccag

SEQ ID NO: 9881 - DNA, 22 bp, Artificial Sequence
  Description of Artificial Sequence: Synthetic oligonucleotide
tggactcatgcatgagtccagg

SEQ ID NO: 9882 - DNA, 22 bp, Artificial Sequence
  Description of Artificial Sequence: Synthetic oligonucleotide
gtgactcatgcatgagtcacgg

SEQ ID NO: 9883 - DNA, 22 bp, Artificial Sequence
  Description of Artificial Sequence: Synthetic oligonucleotide
gcgactcatgcatgagtcgccg

SEQ ID NO: 9884 - DNA, 22 bp, Artificial Sequence
  Description of Artificial Sequence: Synthetic oligonucleotide
gcgactcatgcatgagtcgctg

SEQ ID NO: 9885 - DNA, 22 bp, Artificial Sequence
  Description of Artificial Sequence: Synthetic oligonucleotide
acgactcatgcatgagtcgtcg

SEQ ID NO: 9886 - DNA, 22 bp, Artificial Sequence
  Description of Artificial Sequence: Synthetic oligonucleotide
gagactcatgcatgagtctccg

SEQ ID NO: 9887 - DNA, 22 bp, Artificial Sequence
  Description of Artificial Sequence: Synthetic oligonucleotide
gcgactcatgcatgagtcgcag

SEQ ID NO: 9888 - DNA, 22 bp, Artificial Sequence
  Description of Artificial Sequence: Synthetic oligonucleotide
gtgactcatgcatgagtcaccg

SEQ ID NO: 9889 - DNA, 22 bp, Artificial Sequence
  Description of Artificial Sequence: Synthetic oligonucleotide
cggactcatgcatgagtccgtg

SEQ ID NO: 9890 - DNA, 22 bp, Artificial Sequence
  Description of Artificial Sequence: Synthetic oligonucleotide
cagactcatgcatgagtctggg

SEQ ID NO: 9891 - DNA, 22 bp, Artificial Sequence
  Description of Artificial Sequence: Synthetic oligonucleotide
cggactcatgcatgagtccgag

SEQ ID NO: 9892 - DNA, 22 bp, Artificial Sequence
  Description of Artificial Sequence: Synthetic oligonucleotide
ctgactcatgcatgagtcaggg

SEQ ID NO: 9893 - DNA, 22 bp, Artificial Sequence
  Description of Artificial Sequence: Synthetic oligonucleotide
acgactcatgcatgagtcgtgg

SEQ ID NO: 9894 - DNA, 22 bp, Artificial Sequence
  Description of Artificial Sequence: Synthetic oligonucleotide
ccgactcatgcatgagtcggct

SEQ ID NO: 9895 - DNA, 22 bp, Artificial Sequence
  Description of Artificial Sequence: Synthetic oligonucleotide
ccgactcatgcatgagtcggca

SEQ ID NO: 9896 - DNA, 22 bp, Artificial Sequence
  Description of Artificial Sequence: Synthetic oligonucleotide
gagactcatgcatgagtctcgc

SEQ ID NO: 9897 - DNA, 22 bp, Artificial Sequence
  Description of Artificial Sequence: Synthetic oligonucleotide
gtgactcatgcatgagtcacgc

SEQ ID NO: 9898 - DNA, 22 bp, Artificial Sequence
  Description of Artificial Sequence: Synthetic oligonucleotide
aggactcatgcatgagtcctgc

SEQ ID NO: 9899 - DNA, 22 bp, Artificial Sequence
  Description of Artificial Sequence: Synthetic oligonucleotide
tggactcatgcatgagtccagc

SEQ ID NO: 9900 - DNA, 22 bp, Artificial Sequence
  Description of Artificial Sequence: Synthetic oligonucleotide
aggactcatgcatgagtcctcg

SEQ ID NO: 9901 - DNA, 22 bp, Artificial Sequence
  Description of Artificial Sequence: Synthetic oligonucleotide
tggactcatgcatgagtccacg

SEQ ID NO: 9902 - DNA, 22 bp, Artificial Sequence
  Description of Artificial Sequence: Synthetic oligonucleotide
ccgactcatgcatgagtcggtg

SEQ ID NO: 9903 - DNA, 22 bp, Artificial Sequence
  Description of Artificial Sequence: Synthetic oligonucleotide
ccgactcatgcatgagtcggag

SEQ ID NO: 9904 - DNA, 22 bp, Artificial Sequence
  Description of Artificial Sequence: Synthetic oligonucleotide
gggactcatgcatgagtcccgc

SEQ ID NO: 9905 - DNA, 22 bp, Artificial Sequence
  Description of Artificial Sequence: Synthetic oligonucleotide
gggactcatgcatgagtccctc

SEQ ID NO: 9906 - DNA, 22 bp, Artificial Sequence
  Description of Artificial Sequence: Synthetic oligonucleotide
gggactcatgcatgagtcccac

SEQ ID NO: 9907 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcatcgatgagtcnnnn

SEQ ID NO: 9908 - DNA, 22 bp, Artificial Sequence
  Description of Artificial Sequence: Synthetic oligonucleotide
cggactcatcgatgagtccgcc

SEQ ID NO: 9909 - DNA, 22 bp, Artificial Sequence
  Description of Artificial Sequence: Synthetic oligonucleotide
cggactcatcgatgagtccgct

SEQ ID NO: 9910 - DNA, 22 bp, Artificial Sequence
  Description of Artificial Sequence: Synthetic oligonucleotide
cggactcatcgatgagtccgtc

SEQ ID NO: 9911 - DNA, 22 bp, Artificial Sequence
  Description of Artificial Sequence: Synthetic oligonucleotide
aggactcatcgatgagtcctcc

SEQ ID NO: 9912 - DNA, 22 bp, Artificial Sequence
  Description of Artificial Sequence: Synthetic oligonucleotide
cagactcatcgatgagtctgcc

SEQ ID NO: 9913 - DNA, 22 bp, Artificial Sequence
  Description of Artificial Sequence: Synthetic oligonucleotide
cggactcatcgatgagtccgca

SEQ ID NO: 9914 - DNA, 22 bp, Artificial Sequence
  Description of Artificial Sequence: Synthetic oligonucleotide
cggactcatcgatgagtccgac

SEQ ID NO: 9915 - DNA, 22 bp, Artificial Sequence
  Description of Artificial Sequence: Synthetic oligonucleotide
tggactcatcgatgagtccacc

SEQ ID NO: 9916 - DNA, 22 bp, Artificial Sequence
  Description of Artificial Sequence: Synthetic oligonucleotide
ctgactcatcgatgagtcagcc

SEQ ID NO: 9917 - DNA, 22 bp, Artificial Sequence
  Description of Artificial Sequence: Synthetic oligonucleotide
ccgactcatcgatgagtcgggc

SEQ ID NO: 9918 - DNA, 22 bp, Artificial Sequence
  Description of Artificial Sequence: Synthetic oligonucleotide
ccgactcatcgatgagtcgggt

SEQ ID NO: 9919 - DNA, 22 bp, Artificial Sequence
  Description of Artificial Sequence: Synthetic oligonucleotide
ccgactcatcgatgagtcggtc

SEQ ID NO: 9920 - DNA, 22 bp, Artificial Sequence
  Description of Artificial Sequence: Synthetic oligonucleotide
acgactcatcgatgagtcgtgc

SEQ ID NO: 9921 - DNA, 22 bp, Artificial Sequence
  Description of Artificial Sequence: Synthetic oligonucleotide
cagactcatcgatgagtctggc

SEQ ID NO: 9922 - DNA, 22 bp, Artificial Sequence
  Description of Artificial Sequence: Synthetic oligonucleotide
ccgactcatcgatgagtcggga

SEQ ID NO: 9923 - DNA, 22 bp, Artificial Sequence
  Description of Artificial Sequence: Synthetic oligonucleotide
ccgactcatcgatgagtcggac

SEQ ID NO: 9924 - DNA, 22 bp, Artificial Sequence
  Description of Artificial Sequence: Synthetic oligonucleotide
ctgactcatcgatgagtcaggc

SEQ ID NO: 9925 - DNA, 22 bp, Artificial Sequence
  Description of Artificial Sequence: Synthetic oligonucleotide
gcgactcatcgatgagtcgccc

SEQ ID NO: 9926 - DNA, 22 bp, Artificial Sequence
  Description of Artificial Sequence: Synthetic oligonucleotide
gcgactcatcgatgagtcgcct

SEQ ID NO: 9927 - DNA, 22 bp, Artificial Sequence
  Description of Artificial Sequence: Synthetic oligonucleotide
gcgactcatcgatgagtcgctc

SEQ ID NO: 9928 - DNA, 22 bp, Artificial Sequence
  Description of Artificial Sequence: Synthetic oligonucleotide
acgactcatcgatgagtcgtcc

SEQ ID NO: 9929 - DNA, 22 bp, Artificial Sequence
  Description of Artificial Sequence: Synthetic oligonucleotide
gagactcatcgatgagtctccc

SEQ ID NO: 9930 - DNA, 22 bp, Artificial Sequence
  Description of Artificial Sequence: Synthetic oligonucleotide
gcgactcatcgatgagtcgcca

SEQ ID NO: 9931 - DNA, 22 bp, Artificial Sequence
  Description of Artificial Sequence: Synthetic oligonucleotide
gcgactcatcgatgagtcgcac

SEQ ID NO: 9932 - DNA, 22 bp, Artificial Sequence
  Description of Artificial Sequence: Synthetic oligonucleotide
gtgactcatcgatgagtcaccc

SEQ ID NO: 9933 - DNA, 22 bp, Artificial Sequence
  Description of Artificial Sequence: Synthetic oligonucleotide
gggactcatcgatgagtcccgt

SEQ ID NO: 9934 - DNA, 22 bp, Artificial Sequence
  Description of Artificial Sequence: Synthetic oligonucleotide
gggactcatcgatgagtccctg

SEQ ID NO: 9935 - DNA, 22 bp, Artificial Sequence
  Description of Artificial Sequence: Synthetic oligonucleotide
aggactcatcgatgagtcctgg

SEQ ID NO: 9936 - DNA, 22 bp, Artificial Sequence
  Description of Artificial Sequence: Synthetic oligonucleotide
gagactcatcgatgagtctcgg

SEQ ID NO: 9937 - DNA, 22 bp, Artificial Sequence
  Description of Artificial Sequence: Synthetic oligonucleotide
gggactcatcgatgagtcccga

SEQ ID NO: 9938 - DNA, 22 bp, Artificial Sequence
  Description of Artificial Sequence: Synthetic oligonucleotide
gggactcatcgatgagtcccag

SEQ ID NO: 9939 - DNA, 22 bp, Artificial Sequence
  Description of Artificial Sequence: Synthetic oligonucleotide
tggactcatcgatgagtccagg

SEQ ID NO: 9940 - DNA, 22 bp, Artificial Sequence
  Description of Artificial Sequence: Synthetic oligonucleotide
gtgactcatcgatgagtcacgg

SEQ ID NO: 9941 - DNA, 22 bp, Artificial Sequence
  Description of Artificial Sequence: Synthetic oligonucleotide
gcgactcatcgatgagtcgccg

SEQ ID NO: 9942 - DNA, 22 bp, Artificial Sequence
  Description of Artificial Sequence: Synthetic oligonucleotide
gcgactcatcgatgagtcgctg

SEQ ID NO: 9943 - DNA, 22 bp, Artificial Sequence
  Description of Artificial Sequence: Synthetic oligonucleotide
acgactcatcgatgagtcgtcg

SEQ ID NO: 9944 - DNA, 22 bp, Artificial Sequence
  Description of Artificial Sequence: Synthetic oligonucleotide
gagactcatcgatgagtctccg

SEQ ID NO: 9945 - DNA, 22 bp, Artificial Sequence
  Description of Artificial Sequence: Synthetic oligonucleotide
gcgactcatcgatgagtcgcag

SEQ ID NO: 9946 - DNA, 22 bp, Artificial Sequence
  Description of Artificial Sequence: Synthetic oligonucleotide
gtgactcatcgatgagtcaccg

SEQ ID NO: 9947 - DNA, 22 bp, Artificial Sequence
  Description of Artificial Sequence: Synthetic oligonucleotide
cggactcatcgatgagtccgtg

SEQ ID NO: 9948 - DNA, 22 bp, Artificial Sequence
  Description of Artificial Sequence: Synthetic oligonucleotide
cagactcatcgatgagtctggg

SEQ ID NO: 9949 - DNA, 22 bp, Artificial Sequence
  Description of Artificial Sequence: Synthetic oligonucleotide
cggactcatcgatgagtccgag

SEQ ID NO: 9950 - DNA, 22 bp, Artificial Sequence
  Description of Artificial Sequence: Synthetic oligonucleotide
ctgactcatcgatgagtcaggg

SEQ ID NO: 9951 - DNA, 22 bp, Artificial Sequence
  Description of Artificial Sequence: Synthetic oligonucleotide
acgactcatcgatgagtcgtgg

SEQ ID NO: 9952 - DNA, 22 bp, Artificial Sequence
  Description of Artificial Sequence: Synthetic oligonucleotide
ccgactcatcgatgagtcggct

SEQ ID NO: 9953 - DNA, 22 bp, Artificial Sequence
  Description of Artificial Sequence: Synthetic oligonucleotide
ccgactcatcgatgagtcggca

SEQ ID NO: 9954 - DNA, 22 bp, Artificial Sequence
  Description of Artificial Sequence: Synthetic oligonucleotide
gagactcatcgatgagtctcgc

SEQ ID NO: 9955 - DNA, 22 bp, Artificial Sequence
  Description of Artificial Sequence: Synthetic oligonucleotide
gtgactcatcgatgagtcacgc

SEQ ID NO: 9956 - DNA, 22 bp, Artificial Sequence
  Description of Artificial Sequence: Synthetic oligonucleotide
aggactcatcgatgagtcctgc

SEQ ID NO: 9957 - DNA, 22 bp, Artificial Sequence
  Description of Artificial Sequence: Synthetic oligonucleotide
tggactcatcgatgagtccagc

SEQ ID NO: 9958 - DNA, 22 bp, Artificial Sequence
  Description of Artificial Sequence: Synthetic oligonucleotide
aggactcatcgatgagtcctcg

SEQ ID NO: 9959 - DNA, 22 bp, Artificial Sequence
  Description of Artificial Sequence: Synthetic oligonucleotide
tggactcatcgatgagtccacg

SEQ ID NO: 9960 - DNA, 22 bp, Artificial Sequence
  Description of Artificial Sequence: Synthetic oligonucleotide
ccgactcatcgatgagtcggtg

SEQ ID NO: 9961 - DNA, 22 bp, Artificial Sequence
  Description of Artificial Sequence: Synthetic oligonucleotide
ccgactcatcgatgagtcggag

SEQ ID NO: 9962 - DNA, 22 bp, Artificial Sequence
  Description of Artificial Sequence: Synthetic oligonucleotide
gggactcatcgatgagtcccgc

SEQ ID NO: 9963 - DNA, 22 bp, Artificial Sequence
  Description of Artificial Sequence: Synthetic oligonucleotide
gggactcatcgatgagtccctc

SEQ ID NO: 9964 - DNA, 22 bp, Artificial Sequence
  Description of Artificial Sequence: Synthetic oligonucleotide
gggactcatcgatgagtcccac

SEQ ID NO: 9965 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcttataagagtcnnnn

SEQ ID NO: 9966 - DNA, 22 bp, Artificial Sequence
  Description of Artificial Sequence: Synthetic oligonucleotide
cggactcttataagagtccgcc

SEQ ID NO: 9967 - DNA, 22 bp, Artificial Sequence
  Description of Artificial Sequence: Synthetic oligonucleotide
cggactcttataagagtccgct

SEQ ID NO: 9968 - DNA, 22 bp, Artificial Sequence
  Description of Artificial Sequence: Synthetic oligonucleotide
cggactcttataagagtccgtc

SEQ ID NO: 9969 - DNA, 22 bp, Artificial Sequence
  Description of Artificial Sequence: Synthetic oligonucleotide
aggactcttataagagtcctcc

SEQ ID NO: 9970 - DNA, 22 bp, Artificial Sequence
  Description of Artificial Sequence: Synthetic oligonucleotide
cagactcttataagagtctgcc

SEQ ID NO: 9971 - DNA, 22 bp, Artificial Sequence
  Description of Artificial Sequence: Synthetic oligonucleotide
cggactcttataagagtccgca

SEQ ID NO: 9972 - DNA, 22 bp, Artificial Sequence
  Description of Artificial Sequence: Synthetic oligonucleotide
cggactcttataagagtccgac

SEQ ID NO: 9973 - DNA, 22 bp, Artificial Sequence
  Description of Artificial Sequence: Synthetic oligonucleotide
tggactcttataagagtccacc

SEQ ID NO: 9974 - DNA, 22 bp, Artificial Sequence
  Description of Artificial Sequence: Synthetic oligonucleotide
ctgactcttataagagtcagcc

SEQ ID NO: 9975 - DNA, 22 bp, Artificial Sequence
  Description of Artificial Sequence: Synthetic oligonucleotide
ccgactcttataagagtcgggc

SEQ ID NO: 9976 - DNA, 22 bp, Artificial Sequence
  Description of Artificial Sequence: Synthetic oligonucleotide
ccgactcttataagagtcgggt

SEQ ID NO: 9977 - DNA, 22 bp, Artificial Sequence
  Description of Artificial Sequence: Synthetic oligonucleotide
ccgactcttataagagtcggtc

SEQ ID NO: 9978 - DNA, 22 bp, Artificial Sequence
  Description of Artificial Sequence: Synthetic oligonucleotide
acgactcttataagagtcgtgc

SEQ ID NO: 9979 - DNA, 22 bp, Artificial Sequence
  Description of Artificial Sequence: Synthetic oligonucleotide
cagactcttataagagtctggc

SEQ ID NO: 9980 - DNA, 22 bp, Artificial Sequence
  Description of Artificial Sequence: Synthetic oligonucleotide
ccgactcttataagagtcggga

SEQ ID NO: 9981 - DNA, 22 bp, Artificial Sequence
  Description of Artificial Sequence: Synthetic oligonucleotide
ccgactcttataagagtcggac

SEQ ID NO: 9982 - DNA, 22 bp, Artificial Sequence
  Description of Artificial Sequence: Synthetic oligonucleotide
ctgactcttataagagtcaggc

SEQ ID NO: 9983 - DNA, 22 bp, Artificial Sequence
  Description of Artificial Sequence: Synthetic oligonucleotide
gcgactcttataagagtcgccc

SEQ ID NO: 9984 - DNA, 22 bp, Artificial Sequence
  Description of Artificial Sequence: Synthetic oligonucleotide
gcgactcttataagagtcgcct

SEQ ID NO: 9985 - DNA, 22 bp, Artificial Sequence
  Description of Artificial Sequence: Synthetic oligonucleotide
gcgactcttataagagtcgctc

SEQ ID NO: 9986 - DNA, 22 bp, Artificial Sequence
  Description of Artificial Sequence: Synthetic oligonucleotide
acgactcttataagagtcgtcc

SEQ ID NO: 9987 - DNA, 22 bp, Artificial Sequence
  Description of Artificial Sequence: Synthetic oligonucleotide
gagactcttataagagtctccc

SEQ ID NO: 9988 - DNA, 22 bp, Artificial Sequence
  Description of Artificial Sequence: Synthetic oligonucleotide
gcgactcttataagagtcgcca

SEQ ID NO: 9989 - DNA, 22 bp, Artificial Sequence
  Description of Artificial Sequence: Synthetic oligonucleotide
gcgactcttataagagtcgcac

SEQ ID NO: 9990 - DNA, 22 bp, Artificial Sequence
  Description of Artificial Sequence: Synthetic oligonucleotide
gtgactcttataagagtcaccc

SEQ ID NO: 9991 - DNA, 22 bp, Artificial Sequence
  Description of Artificial Sequence: Synthetic oligonucleotide
gggactcttataagagtcccgt

SEQ ID NO: 9992 - DNA, 22 bp, Artificial Sequence
  Description of Artificial Sequence: Synthetic oligonucleotide
gggactcttataagagtccctg

SEQ ID NO: 9993 - DNA, 22 bp, Artificial Sequence
  Description of Artificial Sequence: Synthetic oligonucleotide
aggactcttataagagtcctgg

SEQ ID NO: 9994 - DNA, 22 bp, Artificial Sequence
  Description of Artificial Sequence: Synthetic oligonucleotide
gagactcttataagagtctcgg

SEQ ID NO: 9995 - DNA, 22 bp, Artificial Sequence
  Description of Artificial Sequence: Synthetic oligonucleotide
gggactcttataagagtcccga

SEQ ID NO: 9996 - DNA, 22 bp, Artificial Sequence
  Description of Artificial Sequence: Synthetic oligonucleotide
gggactcttataagagtcccag

SEQ ID NO: 9997 - DNA, 22 bp, Artificial Sequence
  Description of Artificial Sequence: Synthetic oligonucleotide
tggactcttataagagtccagg

SEQ ID NO: 9998 - DNA, 22 bp, Artificial Sequence
  Description of Artificial Sequence: Synthetic oligonucleotide
gtgactcttataagagtcacgg

SEQ ID NO: 9999 - DNA, 22 bp, Artificial Sequence
  Description of Artificial Sequence: Synthetic oligonucleotide
gcgactcttataagagtcgccg

SEQ ID NO: 10000 - DNA, 22 bp, Artificial Sequence
  Description of Artificial Sequence: Synthetic oligonucleotide
gcgactcttataagagtcgctg

SEQ ID NO: 10001 - DNA, 22 bp, Artificial Sequence
  Description of Artificial Sequence: Synthetic oligonucleotide
acgactcttataagagtcgtcg

SEQ ID NO: 10002 - DNA, 22 bp, Artificial Sequence
  Description of Artificial Sequence: Synthetic oligonucleotide
gagactcttataagagtctccg

SEQ ID NO: 10003 - DNA, 22 bp, Artificial Sequence
  Description of Artificial Sequence: Synthetic oligonucleotide
gcgactcttataagagtcgcag

SEQ ID NO: 10004 - DNA, 22 bp, Artificial Sequence
  Description of Artificial Sequence: Synthetic oligonucleotide
gtgactcttataagagtcaccg

SEQ ID NO: 10005 - DNA, 22 bp, Artificial Sequence
  Description of Artificial Sequence: Synthetic oligonucleotide
cggactcttataagagtccgtg

SEQ ID NO: 10006 - DNA, 22 bp, Artificial Sequence
  Description of Artificial Sequence: Synthetic oligonucleotide
cagactcttataagagtctggg

SEQ ID NO: 10007 - DNA, 22 bp, Artificial Sequence
  Description of Artificial Sequence: Synthetic oligonucleotide
cggactcttataagagtccgag

SEQ ID NO: 10008 - DNA, 22 bp, Artificial Sequence
  Description of Artificial Sequence: Synthetic oligonucleotide
ctgactcttataagagtcaggg

SEQ ID NO: 10009 - DNA, 22 bp, Artificial Sequence
  Description of Artificial Sequence: Synthetic oligonucleotide
acgactcttataagagtcgtgg

SEQ ID NO: 10010 - DNA, 22 bp, Artificial Sequence
  Description of Artificial Sequence: Synthetic oligonucleotide
ccgactcttataagagtcggct

SEQ ID NO: 10011 - DNA, 22 bp, Artificial Sequence
  Description of Artificial Sequence: Synthetic oligonucleotide
ccgactcttataagagtcggca

SEQ ID NO: 10012 - DNA, 22 bp, Artificial Sequence
  Description of Artificial Sequence: Synthetic oligonucleotide
gagactcttataagagtctcgc

SEQ ID NO: 10013 - DNA, 22 bp, Artificial Sequence
  Description of Artificial Sequence: Synthetic oligonucleotide
gtgactcttataagagtcacgc

SEQ ID NO: 10014 - DNA, 22 bp, Artificial Sequence
  Description of Artificial Sequence: Synthetic oligonucleotide
aggactcttataagagtcctgc

SEQ ID NO: 10015 - DNA, 22 bp, Artificial Sequence
  Description of Artificial Sequence: Synthetic oligonucleotide
tggactcttataagagtccagc

SEQ ID NO: 10016 - DNA, 22 bp, Artificial Sequence
  Description of Artificial Sequence: Synthetic oligonucleotide
aggactcttataagagtcctcg

SEQ ID NO: 10017 - DNA, 22 bp, Artificial Sequence
  Description of Artificial Sequence: Synthetic oligonucleotide
tggactcttataagagtccacg

SEQ ID NO: 10018 - DNA, 22 bp, Artificial Sequence
  Description of Artificial Sequence: Synthetic oligonucleotide
ccgactcttataagagtcggtg

SEQ ID NO: 10019 - DNA, 22 bp, Artificial Sequence
  Description of Artificial Sequence: Synthetic oligonucleotide
ccgactcttataagagtcggag

SEQ ID NO: 10020 - DNA, 22 bp, Artificial Sequence
  Description of Artificial Sequence: Synthetic oligonucleotide
gggactcttataagagtcccgc

SEQ ID NO: 10021 - DNA, 22 bp, Artificial Sequence
  Description of Artificial Sequence: Synthetic oligonucleotide
gggactcttataagagtccctc

SEQ ID NO: 10022 - DNA, 22 bp, Artificial Sequence
  Description of Artificial Sequence: Synthetic oligonucleotide
gggactcttataagagtcccac

SEQ ID NO: 10023 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactctttaaagagtcnnnn

SEQ ID NO: 10024 - DNA, 22 bp, Artificial Sequence
  Description of Artificial Sequence: Synthetic oligonucleotide
cggactctttaaagagtccgcc

SEQ ID NO: 10025 - DNA, 22 bp, Artificial Sequence
  Description of Artificial Sequence: Synthetic oligonucleotide
cggactctttaaagagtccgct

SEQ ID NO: 10026 - DNA, 22 bp, Artificial Sequence
  Description of Artificial Sequence: Synthetic oligonucleotide
cggactctttaaagagtccgtc

SEQ ID NO: 10027 - DNA, 22 bp, Artificial Sequence
  Description of Artificial Sequence: Synthetic oligonucleotide
aggactctttaaagagtcctcc

SEQ ID NO: 10028 - DNA, 22 bp, Artificial Sequence
  Description of Artificial Sequence: Synthetic oligonucleotide
cagactctttaaagagtctgcc

SEQ ID NO: 10029 - DNA, 22 bp, Artificial Sequence
  Description of Artificial Sequence: Synthetic oligonucleotide
cggactctttaaagagtccgca

SEQ ID NO: 10030 - DNA, 22 bp, Artificial Sequence
  Description of Artificial Sequence: Synthetic oligonucleotide
cggactctttaaagagtccgac

SEQ ID NO: 10031 - DNA, 22 bp, Artificial Sequence
  Description of Artificial Sequence: Synthetic oligonucleotide
tggactctttaaagagtccacc

SEQ ID NO: 10032 - DNA, 22 bp, Artificial Sequence
  Description of Artificial Sequence: Synthetic oligonucleotide
ctgactctttaaagagtcagcc

SEQ ID NO: 10033 - DNA, 22 bp, Artificial Sequence
  Description of Artificial Sequence: Synthetic oligonucleotide
ccgactctttaaagagtcgggc

SEQ ID NO: 10034 - DNA, 22 bp, Artificial Sequence
  Description of Artificial Sequence: Synthetic oligonucleotide
ccgactctttaaagagtcgggt

SEQ ID NO: 10035 - DNA, 22 bp, Artificial Sequence
  Description of Artificial Sequence: Synthetic oligonucleotide
ccgactctttaaagagtcggtc

SEQ ID NO: 10036 - DNA, 22 bp, Artificial Sequence
  Description of Artificial Sequence: Synthetic oligonucleotide
acgactctttaaagagtcgtgc

SEQ ID NO: 10037 - DNA, 22 bp, Artificial Sequence
  Description of Artificial Sequence: Synthetic oligonucleotide
cagactctttaaagagtctggc

SEQ ID NO: 10038 - DNA, 22 bp, Artificial Sequence
  Description of Artificial Sequence: Synthetic oligonucleotide
ccgactctttaaagagtcggga

SEQ ID NO: 10039 - DNA, 22 bp, Artificial Sequence
  Description of Artificial Sequence: Synthetic oligonucleotide
ccgactctttaaagagtcggac

SEQ ID NO: 10040 - DNA, 22 bp, Artificial Sequence
  Description of Artificial Sequence: Synthetic oligonucleotide
ctgactctttaaagagtcaggc

SEQ ID NO: 10041 - DNA, 22 bp, Artificial Sequence
  Description of Artificial Sequence: Synthetic oligonucleotide
gcgactctttaaagagtcgccc

SEQ ID NO: 10042 - DNA, 22 bp, Artificial Sequence
  Description of Artificial Sequence: Synthetic oligonucleotide
gcgactctttaaagagtcgcct

SEQ ID NO: 10043 - DNA, 22 bp, Artificial Sequence
  Description of Artificial Sequence: Synthetic oligonucleotide
gcgactctttaaagagtcgctc

SEQ ID NO: 10044 - DNA, 22 bp, Artificial Sequence
  Description of Artificial Sequence: Synthetic oligonucleotide
acgactctttaaagagtcgtcc

SEQ ID NO: 10045 - DNA, 22 bp, Artificial Sequence
  Description of Artificial Sequence: Synthetic oligonucleotide
gagactctttaaagagtctccc

SEQ ID NO: 10046 - DNA, 22 bp, Artificial Sequence
  Description of Artificial Sequence: Synthetic oligonucleotide
gcgactctttaaagagtcgcca

SEQ ID NO: 10047 - DNA, 22 bp, Artificial Sequence
  Description of Artificial Sequence: Synthetic oligonucleotide
gcgactctttaaagagtcgcac

SEQ ID NO: 10048 - DNA, 22 bp, Artificial Sequence
  Description of Artificial Sequence: Synthetic oligonucleotide
gtgactctttaaagagtcaccc

SEQ ID NO: 10049 - DNA, 22 bp, Artificial Sequence
  Description of Artificial Sequence: Synthetic oligonucleotide
gggactctttaaagagtcccgt

SEQ ID NO: 10050 - DNA, 22 bp, Artificial Sequence
  Description of Artificial Sequence: Synthetic oligonucleotide
gggactctttaaagagtccctg

SEQ ID NO: 10051 - DNA, 22 bp, Artificial Sequence
  Description of Artificial Sequence: Synthetic oligonucleotide
aggactctttaaagagtcctgg

SEQ ID NO: 10052 - DNA, 22 bp, Artificial Sequence
  Description of Artificial Sequence: Synthetic oligonucleotide
gagactctttaaagagtctcgg

SEQ ID NO: 10053 - DNA, 22 bp, Artificial Sequence
  Description of Artificial Sequence: Synthetic oligonucleotide
gggactctttaaagagtcccga

SEQ ID NO: 10054 - DNA, 22 bp, Artificial Sequence
  Description of Artificial Sequence: Synthetic oligonucleotide
gggactctttaaagagtcccag

SEQ ID NO: 10055 - DNA, 22 bp, Artificial Sequence
  Description of Artificial Sequence: Synthetic oligonucleotide
tggactctttaaagagtccagg

SEQ ID NO: 10056 - DNA, 22 bp, Artificial Sequence
  Description of Artificial Sequence: Synthetic oligonucleotide
gtgactctttaaagagtcacgg

SEQ ID NO: 10057 - DNA, 22 bp, Artificial Sequence
  Description of Artificial Sequence: Synthetic oligonucleotide
gcgactctttaaagagtcgccg

SEQ ID NO: 10058 - DNA, 22 bp, Artificial Sequence
  Description of Artificial Sequence: Synthetic oligonucleotide
gcgactctttaaagagtcgctg

SEQ ID NO: 10059 - DNA, 22 bp, Artificial Sequence
  Description of Artificial Sequence: Synthetic oligonucleotide
acgactctttaaagagtcgtcg

SEQ ID NO: 10060 - DNA, 22 bp, Artificial Sequence
  Description of Artificial Sequence: Synthetic oligonucleotide
gagactctttaaagagtctccg

SEQ ID NO: 10061 - DNA, 22 bp, Artificial Sequence
  Description of Artificial Sequence: Synthetic oligonucleotide
gcgactctttaaagagtcgcag

SEQ ID NO: 10062 - DNA, 22 bp, Artificial Sequence
  Description of Artificial Sequence: Synthetic oligonucleotide
gtgactctttaaagagtcaccg

SEQ ID NO: 10063 - DNA, 22 bp, Artificial Sequence
  Description of Artificial Sequence: Synthetic oligonucleotide
cggactctttaaagagtccgtg

SEQ ID NO: 10064 - DNA, 22 bp, Artificial Sequence
  Description of Artificial Sequence: Synthetic oligonucleotide
cagactctttaaagagtctggg

SEQ ID NO: 10065 - DNA, 22 bp, Artificial Sequence
  Description of Artificial Sequence: Synthetic oligonucleotide
cggactctttaaagagtccgag

SEQ ID NO: 10066 - DNA, 22 bp, Artificial Sequence
  Description of Artificial Sequence: Synthetic oligonucleotide
ctgactctttaaagagtcaggg

SEQ ID NO: 10067 - DNA, 22 bp, Artificial Sequence
  Description of Artificial Sequence: Synthetic oligonucleotide
acgactctttaaagagtcgtgg

SEQ ID NO: 10068 - DNA, 22 bp, Artificial Sequence
  Description of Artificial Sequence: Synthetic oligonucleotide
ccgactctttaaagagtcggct

SEQ ID NO: 10069 - DNA, 22 bp, Artificial Sequence
  Description of Artificial Sequence: Synthetic oligonucleotide
ccgactctttaaagagtcggca

SEQ ID NO: 10070 - DNA, 22 bp, Artificial Sequence
  Description of Artificial Sequence: Synthetic oligonucleotide
gagactctttaaagagtctcgc

SEQ ID NO: 10071 - DNA, 22 bp, Artificial Sequence
  Description of Artificial Sequence: Synthetic oligonucleotide
gtgactctttaaagagtcacgc

SEQ ID NO: 10072 - DNA, 22 bp, Artificial Sequence
  Description of Artificial Sequence: Synthetic oligonucleotide
aggactctttaaagagtcctgc

SEQ ID NO: 10073 - DNA, 22 bp, Artificial Sequence
  Description of Artificial Sequence: Synthetic oligonucleotide
tggactctttaaagagtccagc

SEQ ID NO: 10074 - DNA, 22 bp, Artificial Sequence
  Description of Artificial Sequence: Synthetic oligonucleotide
aggactctttaaagagtcctcg

SEQ ID NO: 10075 - DNA, 22 bp, Artificial Sequence
  Description of Artificial Sequence: Synthetic oligonucleotide
tggactctttaaagagtccacg

SEQ ID NO: 10076 - DNA, 22 bp, Artificial Sequence
  Description of Artificial Sequence: Synthetic oligonucleotide
ccgactctttaaagagtcggtg

SEQ ID NO: 10077 - DNA, 22 bp, Artificial Sequence
  Description of Artificial Sequence: Synthetic oligonucleotide
ccgactctttaaagagtcggag

SEQ ID NO: 10078 - DNA, 22 bp, Artificial Sequence
  Description of Artificial Sequence: Synthetic oligonucleotide
gggactctttaaagagtcccgc

SEQ ID NO: 10079 - DNA, 22 bp, Artificial Sequence
  Description of Artificial Sequence: Synthetic oligonucleotide
gggactctttaaagagtccctc

SEQ ID NO: 10080 - DNA, 22 bp, Artificial Sequence
  Description of Artificial Sequence: Synthetic oligonucleotide
gggactctttaaagagtcccac

SEQ ID NO: 10081 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcttgcaagagtcnnnn

SEQ ID NO: 10082 - DNA, 22 bp, Artificial Sequence
  Description of Artificial Sequence: Synthetic oligonucleotide
cggactcttgcaagagtccgcc

SEQ ID NO: 10083 - DNA, 22 bp, Artificial Sequence
  Description of Artificial Sequence: Synthetic oligonucleotide
cggactcttgcaagagtccgct

SEQ ID NO: 10084 - DNA, 22 bp, Artificial Sequence
  Description of Artificial Sequence: Synthetic oligonucleotide
cggactcttgcaagagtccgtc

SEQ ID NO: 10085 - DNA, 22 bp, Artificial Sequence
  Description of Artificial Sequence: Synthetic oligonucleotide
aggactcttgcaagagtcctcc

SEQ ID NO: 10086 - DNA, 22 bp, Artificial Sequence
  Description of Artificial Sequence: Synthetic oligonucleotide
cagactcttgcaagagtctgcc

SEQ ID NO: 10087 - DNA, 22 bp, Artificial Sequence
  Description of Artificial Sequence: Synthetic oligonucleotide
cggactcttgcaagagtccgca

SEQ ID NO: 10088 - DNA, 22 bp, Artificial Sequence
  Description of Artificial Sequence: Synthetic oligonucleotide
cggactcttgcaagagtccgac

SEQ ID NO: 10089 - DNA, 22 bp, Artificial Sequence
  Description of Artificial Sequence: Synthetic oligonucleotide
tggactcttgcaagagtccacc

SEQ ID NO: 10090 - DNA, 22 bp, Artificial Sequence
  Description of Artificial Sequence: Synthetic oligonucleotide
ctgactcttgcaagagtcagcc

SEQ ID NO: 10091 - DNA, 22 bp, Artificial Sequence
  Description of Artificial Sequence: Synthetic oligonucleotide
ccgactcttgcaagagtcgggc

SEQ ID NO: 10092 - DNA, 22 bp, Artificial Sequence
  Description of Artificial Sequence: Synthetic oligonucleotide
ccgactcttgcaagagtcgggt

SEQ ID NO: 10093 - DNA, 22 bp, Artificial Sequence
  Description of Artificial Sequence: Synthetic oligonucleotide
ccgactcttgcaagagtcggtc

SEQ ID NO: 10094 - DNA, 22 bp, Artificial Sequence
  Description of Artificial Sequence: Synthetic oligonucleotide
acgactcttgcaagagtcgtgc

SEQ ID NO: 10095 - DNA, 22 bp, Artificial Sequence
  Description of Artificial Sequence: Synthetic oligonucleotide
cagactcttgcaagagtctggc

SEQ ID NO: 10096 - DNA, 22 bp, Artificial Sequence
  Description of Artificial Sequence: Synthetic oligonucleotide
ccgactcttgcaagagtcggga

SEQ ID NO: 10097 - DNA, 22 bp, Artificial Sequence
  Description of Artificial Sequence: Synthetic oligonucleotide
ccgactcttgcaagagtcggac

SEQ ID NO: 10098 - DNA, 22 bp, Artificial Sequence
  Description of Artificial Sequence: Synthetic oligonucleotide
ctgactcttgcaagagtcaggc

SEQ ID NO: 10099 - DNA, 22 bp, Artificial Sequence
  Description of Artificial Sequence: Synthetic oligonucleotide
gcgactcttgcaagagtcgccc

SEQ ID NO: 10100 - DNA, 22 bp, Artificial Sequence
  Description of Artificial Sequence: Synthetic oligonucleotide
gcgactcttgcaagagtcgcct

SEQ ID NO: 10101 - DNA, 22 bp, Artificial Sequence
  Description of Artificial Sequence: Synthetic oligonucleotide
gcgactcttgcaagagtcgctc

SEQ ID NO: 10102 - DNA, 22 bp, Artificial Sequence
  Description of Artificial Sequence: Synthetic oligonucleotide
acgactcttgcaagagtcgtcc

SEQ ID NO: 10103 - DNA, 22 bp, Artificial Sequence
  Description of Artificial Sequence: Synthetic oligonucleotide
gagactcttgcaagagtctccc

SEQ ID NO: 10104 - DNA, 22 bp, Artificial Sequence
  Description of Artificial Sequence: Synthetic oligonucleotide
gcgactcttgcaagagtcgcca

SEQ ID NO: 10105 - DNA, 22 bp, Artificial Sequence
  Description of Artificial Sequence: Synthetic oligonucleotide
gcgactcttgcaagagtcgcac

SEQ ID NO: 10106 - DNA, 22 bp, Artificial Sequence
  Description of Artificial Sequence: Synthetic oligonucleotide
gtgactcttgcaagagtcaccc

SEQ ID NO: 10107 - DNA, 22 bp, Artificial Sequence
  Description of Artificial Sequence: Synthetic oligonucleotide
gggactcttgcaagagtcccgt

SEQ ID NO: 10108 - DNA, 22 bp, Artificial Sequence
  Description of Artificial Sequence: Synthetic oligonucleotide
gggactcttgcaagagtccctg

SEQ ID NO: 10109 - DNA, 22 bp, Artificial Sequence
  Description of Artificial Sequence: Synthetic oligonucleotide
aggactcttgcaagagtcctgg

SEQ ID NO: 10110 - DNA, 22 bp, Artificial Sequence
  Description of Artificial Sequence: Synthetic oligonucleotide
gagactcttgcaagagtctcgg

SEQ ID NO: 10111 - DNA, 22 bp, Artificial Sequence
  Description of Artificial Sequence: Synthetic oligonucleotide
gggactcttgcaagagtcccga

SEQ ID NO: 10112 - DNA, 22 bp, Artificial Sequence
  Description of Artificial Sequence: Synthetic oligonucleotide
gggactcttgcaagagtcccag

SEQ ID NO: 10113 - DNA, 22 bp, Artificial Sequence
  Description of Artificial Sequence: Synthetic oligonucleotide
tggactcttgcaagagtccagg

SEQ ID NO: 10114 - DNA, 22 bp, Artificial Sequence
  Description of Artificial Sequence: Synthetic oligonucleotide
gtgactcttgcaagagtcacgg

SEQ ID NO: 10115 - DNA, 22 bp, Artificial Sequence
  Description of Artificial Sequence: Synthetic oligonucleotide
gcgactcttgcaagagtcgccg

SEQ ID NO: 10116 - DNA, 22 bp, Artificial Sequence
  Description of Artificial Sequence: Synthetic oligonucleotide
gcgactcttgcaagagtcgctg

SEQ ID NO: 10117 - DNA, 22 bp, Artificial Sequence
  Description of Artificial Sequence: Synthetic oligonucleotide
acgactcttgcaagagtcgtcg

SEQ ID NO: 10118 - DNA, 22 bp, Artificial Sequence
  Description of Artificial Sequence: Synthetic oligonucleotide
gagactcttgcaagagtctccg

SEQ ID NO: 10119 - DNA, 22 bp, Artificial Sequence
  Description of Artificial Sequence: Synthetic oligonucleotide
gcgactcttgcaagagtcgcag

SEQ ID NO: 10120 - DNA, 22 bp, Artificial Sequence
  Description of Artificial Sequence: Synthetic oligonucleotide
gtgactcttgcaagagtcaccg

SEQ ID NO: 10121 - DNA, 22 bp, Artificial Sequence
  Description of Artificial Sequence: Synthetic oligonucleotide
cggactcttgcaagagtccgtg

SEQ ID NO: 10122 - DNA, 22 bp, Artificial Sequence
  Description of Artificial Sequence: Synthetic oligonucleotide
cagactcttgcaagagtctggg

SEQ ID NO: 10123 - DNA, 22 bp, Artificial Sequence
  Description of Artificial Sequence: Synthetic oligonucleotide
cggactcttgcaagagtccgag

SEQ ID NO: 10124 - DNA, 22 bp, Artificial Sequence
  Description of Artificial Sequence: Synthetic oligonucleotide
ctgactcttgcaagagtcaggg

SEQ ID NO: 10125 - DNA, 22 bp, Artificial Sequence
  Description of Artificial Sequence: Synthetic oligonucleotide
acgactcttgcaagagtcgtgg

SEQ ID NO: 10126 - DNA, 22 bp, Artificial Sequence
  Description of Artificial Sequence: Synthetic oligonucleotide
ccgactcttgcaagagtcggct

SEQ ID NO: 10127 - DNA, 22 bp, Artificial Sequence
  Description of Artificial Sequence: Synthetic oligonucleotide
ccgactcttgcaagagtcggca

SEQ ID NO: 10128 - DNA, 22 bp, Artificial Sequence
  Description of Artificial Sequence: Synthetic oligonucleotide
gagactcttgcaagagtctcgc

SEQ ID NO: 10129 - DNA, 22 bp, Artificial Sequence
  Description of Artificial Sequence: Synthetic oligonucleotide
gtgactcttgcaagagtcacgc

SEQ ID NO: 10130 - DNA, 22 bp, Artificial Sequence
  Description of Artificial Sequence: Synthetic oligonucleotide
aggactcttgcaagagtcctgc

SEQ ID NO: 10131 - DNA, 22 bp, Artificial Sequence
  Description of Artificial Sequence: Synthetic oligonucleotide
tggactcttgcaagagtccagc

SEQ ID NO: 10132 - DNA, 22 bp, Artificial Sequence
  Description of Artificial Sequence: Synthetic oligonucleotide
aggactcttgcaagagtcctcg

SEQ ID NO: 10133 - DNA, 22 bp, Artificial Sequence
  Description of Artificial Sequence: Synthetic oligonucleotide
tggactcttgcaagagtccacg

SEQ ID NO: 10134 - DNA, 22 bp, Artificial Sequence
  Description of Artificial Sequence: Synthetic oligonucleotide
ccgactcttgcaagagtcggtg

SEQ ID NO: 10135 - DNA, 22 bp, Artificial Sequence
  Description of Artificial Sequence: Synthetic oligonucleotide
ccgactcttgcaagagtcggag

SEQ ID NO: 10136 - DNA, 22 bp, Artificial Sequence
  Description of Artificial Sequence: Synthetic oligonucleotide
gggactcttgcaagagtcccgc

SEQ ID NO: 10137 - DNA, 22 bp, Artificial Sequence
  Description of Artificial Sequence: Synthetic oligonucleotide
gggactcttgcaagagtccctc

SEQ ID NO: 10138 - DNA, 22 bp, Artificial Sequence
  Description of Artificial Sequence: Synthetic oligonucleotide
gggactcttgcaagagtcccac

SEQ ID NO: 10139 - DNA, 22 bp, Artificial Sequence
  Description of Artificial Sequence: Synthetic oligonucleotide
  modified_base (1)..(2): a, c, t, or g
  modified_base (19)..(22): a, c, t, or g
nngactcttcgaagagtcnnnn

SEQ ID NO: 10140 - DNA, 22 bp, Artificial Sequence
  Description of Artificial Sequence: Synthetic oligonucleotide
cggactcttcgaagagtccgcc

SEQ ID NO: 10141 - DNA, 22 bp, Artificial Sequence
  Description of Artificial Sequence: Synthetic oligonucleotide
cggactcttcgaagagtccgct

SEQ ID NO: 10142 - DNA, 22 bp, Artificial Sequence
  Description of Artificial Sequence: Synthetic oligonucleotide
cggactcttcgaagagtccgtc

SEQ ID NO: 10143 - DNA, 22 bp, Artificial Sequence
  Description of Artificial Sequence: Synthetic oligonucleotide
aggactcttcgaagagtcctcc

SEQ ID NO: 10144 - DNA, 22 bp, Artificial Sequence
  Description of Artificial Sequence: Synthetic oligonucleotide
cagactcttcgaagagtctgcc

SEQ ID NO: 10145 - DNA, 22 bp, Artificial Sequence
  Description of Artificial Sequence: Synthetic oligonucleotide
cggactcttcgaagagtccgca

SEQ ID NO: 10146 - DNA, 22 bp, Artificial Sequence
  Description of Artificial Sequence: Synthetic oligonucleotide
cggactcttcgaagagtccgac

SEQ ID NO: 10147 - DNA, 22 bp, Artificial Sequence
  Description of Artificial Sequence: Synthetic oligonucleotide
tggactcttcgaagagtccacc

SEQ ID NO: 10148 - DNA, 22 bp, Artificial Sequence
  Description of Artificial Sequence: Synthetic oligonucleotide
ctgactcttcgaagagtcagcc

SEQ ID NO: 10149 - DNA, 22 bp, Artificial Sequence
  Description of Artificial Sequence: Synthetic oligonucleotide
ccgactcttcgaagagtcgggc

SEQ ID NO: 10150 - DNA, 22 bp, Artificial Sequence
  Description of Artificial Sequence: Synthetic oligonucleotide
ccgactcttcgaagagtcgggt

SEQ ID NO: 10151 - DNA, 22 bp, Artificial Sequence
  Description of Artificial Sequence: Synthetic oligonucleotide
ccgactcttcgaagagtcggtc

SEQ ID NO: 10152 - DNA, 22 bp, Artificial Sequence
  Description of Artificial Sequence: Synthetic oligonucleotide
acgactcttcgaagagtcgtgc

SEQ ID NO: 10153 - DNA, 22 bp, Artificial Sequence
  Description of Artificial Sequence: Synthetic oligonucleotide
cagactcttcgaagagtctggc

SEQ ID NO: 10154 - DNA, 22 bp, Artificial Sequence
  Description of Artificial Sequence: Synthetic oligonucleotide
ccgactcttcgaagagtcggga

SEQ ID NO: 10155 - DNA, 22 bp, Artificial Sequence
  Description of Artificial Sequence: Synthetic oligonucleotide
ccgactcttcgaagagtcggac

SEQ ID NO: 10156 - DNA, 22 bp, Artificial Sequence
  Description of Artificial Sequence: Synthetic oligonucleotide
ctgactcttcgaagagtcaggc

SEQ ID NO: 10157 - DNA, 22 bp, Artificial Sequence
  Description of Artificial Sequence: Synthetic oligonucleotide
gcgactcttcgaagagtcgccc

SEQ ID NO: 10158 - DNA, 22 bp, Artificial Sequence
  Description of Artificial Sequence: Synthetic oligonucleotide
gcgactcttcgaagagtcgcct

SEQ ID NO: 10159 - DNA, 22 bp, Artificial Sequence
  Description of Artificial Sequence: Synthetic oligonucleotide
gcgactcttcgaagagtcgctc

SEQ ID NO: 10160 - DNA, 22 bp, Artificial Sequence
  Description of Artificial Sequence: Synthetic oligonucleotide
acgactcttcgaagagtcgtcc

SEQ ID NO: 10161 - DNA, 22 bp, Artificial Sequence
  Description of Artificial Sequence: Synthetic oligonucleotide
gagactcttcgaagagtctccc

SEQ ID NO: 10162 - DNA, 22 bp, Artificial Sequence
  Description of Artificial Sequence: Synthetic oligonucleotide
gcgactcttcgaagagtcgcca

SEQ ID NO: 10163 - DNA, 22 bp, Artificial Sequence
  Description of Artificial Sequence: Synthetic oligonucleotide
gcgactcttcgaagagtcgcac

SEQ ID NO: 10164 - DNA, 22 bp, Artificial Sequence
  Description of Artificial Sequence: Synthetic oligonucleotide
gtgactcttcgaagagtcaccc

SEQ ID NO: 10165 - DNA, 22 bp, Artificial Sequence
  Description of Artificial Sequence: Synthetic oligonucleotide
gggactcttcgaagagtcccgt

SEQ ID NO: 10166 - DNA, 22 bp, Artificial Sequence
  Description of Artificial Sequence: Synthetic oligonucleotide
gggactcttcgaagagtccctg

SEQ ID NO: 10167 - DNA, 22 bp, Artificial Sequence
  Description of Artificial Sequence: Synthetic oligonucleotide
aggactcttcgaagagtcctgg

SEQ ID NO: 10168 - DNA, 22 bp, Artificial Sequence
  Description of Artificial Sequence: Synthetic oligonucleotide
gagactcttcgaagagtctcgg

SEQ ID NO: 10169 - DNA, 22 bp, Artificial Sequence
  Description of Artificial Sequence: Synthetic oligonucleotide
gggactcttcgaagagtcccga

SEQ ID NO: 10170 - DNA, 22 bp, Artificial Sequence
  Description of Artificial Sequence: Synthetic oligonucleotide
gggactcttcgaagagtcccag

SEQ ID NO: 10171 - DNA, 22 bp, Artificial Sequence
  Description of Artificial Sequence: Synthetic oligonucleotide
tggactcttcgaagagtccagg

SEQ ID NO: 10172 - DNA, 22 bp, Artificial Sequence
  Description of Artificial Sequence: Synthetic oligonucleotide
gtgactcttcgaagagtcacgg

SEQ ID NO: 10173 - DNA, 22 bp, Artificial Sequence
  Description of Artificial Sequence: Synthetic oligonucleotide
gcgactcttcgaagagtcgccg

SEQ ID NO: 10174 - DNA, 22 bp, Artificial Sequence
  Description of Artificial Sequence: Synthetic oligonucleotide
gcgactcttcgaagagtcgctg

SEQ ID NO: 10175 - DNA, 22 bp, Artificial Sequence
  Description of Artificial Sequence: Synthetic oligonucleotide
acgactcttcgaagagtcgtcg

SEQ ID NO: 10176 - DNA, 22 bp, Artificial Sequence
  Description of Artificial Sequence: Synthetic oligonucleotide
gagactcttcgaagagtctccg

SEQ ID NO: 10177 - DNA, 22 bp, Artificial Sequence
  Description of Artificial Sequence: Synthetic oligonucleotide
gcgactcttcgaagagtcgcag

SEQ ID NO: 10178 - DNA, 22 bp, Artificial Sequence
  Description of Artificial Sequence: Synthetic oligonucleotide
gtgactcttcgaagagtcaccg

SEQ ID NO: 10179 - DNA, 22 bp, Artificial Sequence
  Description of Artificial Sequence: Synthetic oligonucleotide
cggactcttcgaagagtccgtg

SEQ ID NO: 10180 - DNA, 22 bp, Artificial Sequence
  Description of Artificial Sequence: Synthetic oligonucleotide
cagactcttcgaagagtctggg

SEQ ID NO: 10181 - DNA, 22 bp, Artificial Sequence
  Description of Artificial Sequence: Synthetic oligonucleotide
cggactcttcgaagagtccgag

SEQ ID NO: 10182 - DNA, 22 bp, Artificial Sequence
  Description of Artificial Sequence: Synthetic oligonucleotide
ctgactcttcgaagagtcaggg

SEQ ID NO: 10183 - DNA, 22 bp, Artificial Sequence
  Description of Artificial Sequence: Synthetic oligonucleotide
acgactcttcgaagagtcgtgg

SEQ ID NO: 10184 - DNA, 22 bp, Artificial Sequence
  Description of Artificial Sequence: Synthetic oligonucleotide
ccgactcttcgaagagtcggct

SEQ ID NO: 10185 - DNA, 22 bp, Artificial Sequence
  Description of Artificial Sequence: Synthetic oligonucleotide
ccgactcttcgaagagtcggca

SEQ ID NO: 10186 - DNA, 22 bp, Artificial Sequence
  Description of Artificial Sequence: Synthetic oligonucleotide
gagactcttcgaagagtctcgc

SEQ ID NO: 10187 - DNA, 22 bp, Artificial Sequence
  Description of Artificial Sequence: Synthetic oligonucleotide
gtgactcttcgaagagtcacgc

SEQ ID NO: 10188 - DNA, 22 bp, Artificial Sequence
  Description of Artificial Sequence: Synthetic oligonucleotide
aggactcttcgaagagtcctgc

SEQ ID NO: 10189 - DNA, 22 bp, Artificial Sequence
  Description of Artificial Sequence: Synthetic oligonucleotide
tggactcttcgaagagtccagc

SEQ ID NO: 10190 - DNA, 22 bp, Artificial Sequence
  Description of Artificial Sequence: Synthetic oligonucleotide
aggactcttcgaagagtcctcg

SEQ ID NO: 10191 - DNA, 22 bp, Artificial Sequence
  Description of Artificial Sequence: Synthetic oligonucleotide
tggactcttcgaagagtccacg

SEQ ID NO: 10192 - DNA, 22 bp, Artificial Sequence
  Description of Artificial Sequence: Synthetic oligonucleotide
ccgactcttcgaagagtcggtg

SEQ ID NO: 10193 - DNA, 22 bp, Artificial Sequence
  Description of Artificial Sequence: Synthetic oligonucleotide
ccgactcttcgaagagtcggag

SEQ ID NO: 10194 - DNA, 22 bp, Artificial Sequence
  Description of Artificial Sequence: Synthetic oligonucleotide
gggactcttcgaagagtcccgc

SEQ ID NO: 10195 - DNA, 22 bp, Artificial Sequence
  Description of Artificial Sequence: Synthetic oligonucleotide
gggactcttcgaagagtccctc

SEQ ID NO: 10196 - DNA, 22 bp, Artificial Sequence
  Description of Artificial Sequence: Synthetic oligonucleotide
gggactcttcgaagagtcccac

SEQ ID NO: 10197 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccgatcggagtcn

SEQ ID NO: 10198 - DNA, 18 bp, Artificial Sequence
  Description of Artificial Sequence: Synthetic oligonucleotide
ggactccgatcggagtcc

SEQ ID NO: 10199 - DNA, 18 bp, Artificial Sequence
  Description of Artificial Sequence: Synthetic oligonucleotide
agactccgatcggagtct

SEQ ID NO: 10200 - DNA, 18 bp, Artificial Sequence
  Description of Artificial Sequence: Synthetic oligonucleotide
tgactccgatcggagtca

SEQ ID NO: 10201 - DNA, 18 bp, Artificial Sequence
  Description of Artificial Sequence: Synthetic oligonucleotide
cgactccgatcggagtcg

SEQ ID NO: 10202 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgtgcacgagtcn

SEQ ID NO: 10203 - DNA, 18 bp, Artificial Sequence
  Description of Artificial Sequence: Synthetic oligonucleotide
ggactcgtgcacgagtcc

SEQ ID NO: 10204 - DNA, 18 bp, Artificial Sequence
  Description of Artificial Sequence: Synthetic oligonucleotide
agactcgtgcacgagtct

SEQ ID NO: 10205 - DNA, 18 bp, Artificial Sequence
  Description of Artificial Sequence: Synthetic oligonucleotide
tgactcgtgcacgagtca

SEQ ID NO: 10206 - DNA, 18 bp, Artificial Sequence
  Description of Artificial Sequence: Synthetic oligonucleotide
cgactcgtgcacgagtcg

SEQ ID NO: 10207 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccccggggagtcn

SEQ ID NO: 10208 - DNA, 18 bp, Artificial Sequence
  Description of Artificial Sequence: Synthetic oligonucleotide
ggactccccggggagtcc

SEQ ID NO: 10209 - DNA, 18 bp, Artificial Sequence
  Description of Artificial Sequence: Synthetic oligonucleotide
agactccccggggagtct

SEQ ID NO: 10210 - DNA, 18 bp, Artificial Sequence
  Description of Artificial Sequence: Synthetic oligonucleotide
tgactccccggggagtca

SEQ ID NO: 10211 - DNA, 18 bp, Artificial Sequence
  Description of Artificial Sequence: Synthetic oligonucleotide
cgactccccggggagtcg

SEQ ID NO: 10212 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcggtaccgagtcn

SEQ ID NO: 10213 - DNA, 18 bp, Artificial Sequence
  Description of Artificial Sequence: Synthetic oligonucleotide
ggactcggtaccgagtcc

SEQ ID NO: 10214 - DNA, 18 bp, Artificial Sequence
  Description of Artificial Sequence: Synthetic oligonucleotide
agactcggtaccgagtct

SEQ ID NO: 10215 - DNA, 18 bp, Artificial Sequence
  Description of Artificial Sequence: Synthetic oligonucleotide
tgactcggtaccgagtca

SEQ ID NO: 10216 - DNA, 18 bp, Artificial Sequence
  Description of Artificial Sequence: Synthetic oligonucleotide
cgactcggtaccgagtcg

SEQ ID NO: 10217 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcaccggtgagtcn

SEQ ID NO: 10218 - DNA, 18 bp, Artificial Sequence
  Description of Artificial Sequence: Synthetic oligonucleotide
ggactcaccggtgagtcc

SEQ ID NO: 10219 - DNA, 18 bp, Artificial Sequence
  Description of Artificial Sequence: Synthetic oligonucleotide
agactcaccggtgagtct

SEQ ID NO: 10220 - DNA, 18 bp, Artificial Sequence
  Description of Artificial Sequence: Synthetic oligonucleotide
tgactcaccggtgagtca

SEQ ID NO: 10221 - DNA, 18 bp, Artificial Sequence
  Description of Artificial Sequence: Synthetic oligonucleotide
cgactcaccggtgagtcg

SEQ ID NO: 10222 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccatatggagtcn

SEQ ID NO: 10223 - DNA, 18 bp, Artificial Sequence
  Description of Artificial Sequence: Synthetic oligonucleotide
ggactccatatggagtcc

SEQ ID NO: 10224 - DNA, 18 bp, Artificial Sequence
  Description of Artificial Sequence: Synthetic oligonucleotide
cgactccatatggagtcg

SEQ ID NO: 10225 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgttaacgagtcn

SEQ ID NO: 10226 - DNA, 18 bp, Artificial Sequence
  Description of Artificial Sequence: Synthetic oligonucleotide
ggactcgttaacgagtcc

SEQ ID NO: 10227 - DNA, 18 bp, Artificial Sequence
  Description of Artificial Sequence: Synthetic oligonucleotide
cgactcgttaacgagtcg

SEQ ID NO: 10228 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctctagagagtcn

SEQ ID NO: 10229 - DNA, 18 bp, Artificial Sequence
  Description of Artificial Sequence: Synthetic oligonucleotide
ggactctctagagagtcc

SEQ ID NO: 10230 - DNA, 18 bp, Artificial Sequence
  Description of Artificial Sequence: Synthetic oligonucleotide
cgactctctagagagtcg

SEQ ID NO: 10231 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcatgcatgagtcn

SEQ ID NO: 10232 - DNA, 18 bp, Artificial Sequence
  Description of Artificial Sequence: Synthetic oligonucleotide
ggactcatgcatgagtcc

SEQ ID NO: 10233 - DNA, 18 bp, Artificial Sequence
  Description of Artificial Sequence: Synthetic oligonucleotide
tgactcatgcatgagtca

SEQ ID NO: 10234 - DNA, 18 bp, Artificial Sequence
  Description of Artificial Sequence: Synthetic oligonucleotide
cgactcatgcatgagtcg

SEQ ID NO: 10235 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcactagtgagtcn

SEQ ID NO: 10236 - DNA, 18 bp, Artificial Sequence
  Description of Artificial Sequence: Synthetic oligonucleotide
cgactcactagtgagtcg

SEQ ID NO: 10237 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccgtacggagtcn

SEQ ID NO: 10238 - DNA, 18 bp, Artificial Sequence
  Description of Artificial Sequence: Synthetic oligonucleotide
ggactccgtacggagtcc

SEQ ID NO: 10239 - DNA, 18 bp, Artificial Sequence
  Description of Artificial Sequence: Synthetic oligonucleotide
agactccgtacggagtct

SEQ ID NO: 10240 - DNA, 18 bp, Artificial Sequence
  Description of Artificial Sequence: Synthetic oligonucleotide
tgactccgtacggagtca

SEQ ID NO: 10241 - DNA, 18 bp, Artificial Sequence
  Description of Artificial Sequence: Synthetic oligonucleotide
cgactccgtacggagtcg

SEQ ID NO: 10242 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcctgcaggagtcn

SEQ ID NO: 10243 - DNA, 18 bp, Artificial Sequence
  Description of Artificial Sequence: Synthetic oligonucleotide
ggactcctgcaggagtcc

SEQ ID NO: 10244 - DNA, 18 bp, Artificial Sequence
  Description of Artificial Sequence: Synthetic oligonucleotide
agactcctgcaggagtct

SEQ ID NO: 10245 - DNA, 18 bp, Artificial Sequence
  Description of Artificial Sequence: Synthetic oligonucleotide
tgactcctgcaggagtca

SEQ ID NO: 10246 - DNA, 18 bp, Artificial Sequence
  Description of Artificial Sequence: Synthetic oligonucleotide
cgactcctgcaggagtcg

SEQ ID NO: 10247 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgtcgacgagtcn

SEQ ID NO: 10248 - DNA, 18 bp, Artificial Sequence
  Description of Artificial Sequence: Synthetic oligonucleotide
ggactcgtcgacgagtcc

SEQ ID NO: 10249 - DNA, 18 bp, Artificial Sequence
  Description of Artificial Sequence: Synthetic oligonucleotide
agactcgtcgacgagtct

SEQ ID NO: 10250 - DNA, 18 bp, Artificial Sequence
  Description of Artificial Sequence: Synthetic oligonucleotide
tgactcgtcgacgagtca

SEQ ID NO: 10251 - DNA, 18 bp, Artificial Sequence
  Description of Artificial Sequence: Synthetic oligonucleotide
cgactcgtcgacgagtcg

SEQ ID NO: 10252 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcagcgctgagtcn

SEQ ID NO: 10253 - DNA, 18 bp, Artificial Sequence
  Description of Artificial Sequence: Synthetic oligonucleotide
ggactcagcgctgagtcc

SEQ ID NO: 10254 - DNA, 18 bp, Artificial Sequence
  Description of Artificial Sequence: Synthetic oligonucleotide
agactcagcgctgagtct

SEQ ID NO: 10255 - DNA, 18 bp, Artificial Sequence
  Description of Artificial Sequence: Synthetic oligonucleotide
tgactcagcgctgagtca

SEQ ID NO: 10256 - DNA, 18 bp, Artificial Sequence
  Description of Artificial Sequence: Synthetic oligonucleotide
cgactcagcgctgagtcg

SEQ ID NO: 10257 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcggcgccgagtcn

SEQ ID NO: 10258 - DNA, 18 bp, Artificial Sequence
  Description of Artificial Sequence: Synthetic oligonucleotide
ggactcggcgccgagtcc

SEQ ID NO: 10259 - DNA, 18 bp, Artificial Sequence
  Description of Artificial Sequence: Synthetic oligonucleotide
agactcggcgccgagtct

SEQ ID NO: 10260 - DNA, 18 bp, Artificial Sequence
  Description of Artificial Sequence: Synthetic oligonucleotide
tgactcggcgccgagtca

SEQ ID NO: 10261 - DNA, 18 bp, Artificial Sequence
  Description of Artificial Sequence: Synthetic oligonucleotide
cgactcggcgccgagtcg

SEQ ID NO: 10262 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcacatgtgagtcn

SEQ ID NO: 10263 - DNA, 18 bp, Artificial Sequence
  Description of Artificial Sequence: Synthetic oligonucleotide
ggactcacatgtgagtcc

SEQ ID NO: 10264 - DNA, 18 bp, Artificial Sequence
  Description of Artificial Sequence: Synthetic oligonucleotide
cgactcacatgtgagtcg

SEQ ID NO: 10265 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctagctagagtcn

SEQ ID NO: 10266 - DNA, 18 bp, Artificial Sequence
  Description of Artificial Sequence: Synthetic oligonucleotide
ggactctagctagagtcc

SEQ ID NO: 10267 - DNA, 18 bp, Artificial Sequence
  Description of Artificial Sequence: Synthetic oligonucleotide
cgactctagctagagtcg

SEQ ID NO: 10268 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcagtactgagtcn

SEQ ID NO: 10269 - DNA, 18 bp, Artificial Sequence
  Description of Artificial Sequence: Synthetic oligonucleotide
ggactcagtactgagtcc

SEQ ID NO: 10270 - DNA, 18 bp, Artificial Sequence
  Description of Artificial Sequence: Synthetic oligonucleotide
cgactcagtactgagtcg

SEQ ID NO: 10271 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcaacgttgagtcn

SEQ ID NO: 10272 - DNA, 18 bp, Artificial Sequence
  Description of Artificial Sequence: Synthetic oligonucleotide
ggactcaacgttgagtcc

SEQ ID NO: 10273 - DNA, 18 bp, Artificial Sequence
  Description of Artificial Sequence: Synthetic oligonucleotide
tgactcaacgttgagtca

SEQ ID NO: 10274 - DNA, 18 bp, Artificial Sequence
  Description of Artificial Sequence: Synthetic oligonucleotide
cgactcaacgttgagtcg

SEQ ID NO: 10275 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctgtacagagtcn

SEQ ID NO: 10276 - DNA, 18 bp, Artificial Sequence
  Description of Artificial Sequence: Synthetic oligonucleotide
cgactctgtacagagtcg

SEQ ID NO: 10277 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgcatgcgagtcn

SEQ ID NO: 10278 - DNA, 18 bp, Artificial Sequence
  Description of Artificial Sequence: Synthetic oligonucleotide
ggactcgcatgcgagtcc

SEQ ID NO: 10279 - DNA, 18 bp, Artificial Sequence
  Description of Artificial Sequence: Synthetic oligonucleotide
agactcgcatgcgagtct

SEQ ID NO: 10280 - DNA, 18 bp, Artificial Sequence
  Description of Artificial Sequence: Synthetic oligonucleotide
tgactcgcatgcgagtca

SEQ ID NO: 10281 - DNA, 18 bp, Artificial Sequence
  Description of Artificial Sequence: Synthetic oligonucleotide
cgactcgcatgcgagtcg

SEQ ID NO: 10282 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccagctggagtcn

SEQ ID NO: 10283 - DNA, 18 bp, Artificial Sequence
  Description of Artificial Sequence: Synthetic oligonucleotide
ggactccagctggagtcc

SEQ ID NO: 10284 - DNA, 18 bp, Artificial Sequence
  Description of Artificial Sequence: Synthetic oligonucleotide
agactccagctggagtct

SEQ ID NO: 10285 - DNA, 18 bp, Artificial Sequence
  Description of Artificial Sequence: Synthetic oligonucleotide
tgactccagctggagtca

SEQ ID NO: 10286 - DNA, 18 bp, Artificial Sequence
  Description of Artificial Sequence: Synthetic oligonucleotide
cgactccagctggagtcg

SEQ ID NO: 10287 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcctcgaggagtcn

SEQ ID NO: 10288 - DNA, 18 bp, Artificial Sequence
  Description of Artificial Sequence: Synthetic oligonucleotide
ggactcctcgaggagtcc

SEQ ID NO: 10289 - DNA, 18 bp, Artificial Sequence
  Description of Artificial Sequence: Synthetic oligonucleotide
agactcctcgaggagtct

SEQ ID NO: 10290 - DNA, 18 bp, Artificial Sequence
  Description of Artificial Sequence: Synthetic oligonucleotide
tgactcctcgaggagtca

SEQ ID NO: 10291 - DNA, 18 bp, Artificial Sequence
  Description of Artificial Sequence: Synthetic oligonucleotide
cgactcctcgaggagtcg

SEQ ID NO: 10292 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccctagggagtcn

SEQ ID NO: 10293 - DNA, 18 bp, Artificial Sequence
  Description of Artificial Sequence: Synthetic oligonucleotide
ggactccctagggagtcc

SEQ ID NO: 10294 - DNA, 18 bp, Artificial Sequence
  Description of Artificial Sequence: Synthetic oligonucleotide
agactccctagggagtct

SEQ ID NO: 10295 - DNA, 18 bp, Artificial Sequence
  Description of Artificial Sequence: Synthetic oligonucleotide
tgactccctagggagtca

SEQ ID NO: 10296 - DNA, 18 bp, Artificial Sequence
  Description of Artificial Sequence: Synthetic oligonucleotide
cgactccctagggagtcg

SEQ ID NO: 10297 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcacgcgtgagtcn

SEQ ID NO: 10298 - DNA, 18 bp, Artificial Sequence
  Description of Artificial Sequence: Synthetic oligonucleotide
ggactcacgcgtgagtcc

SEQ ID NO: 10299 - DNA, 18 bp, Artificial Sequence
  Description of Artificial Sequence: Synthetic oligonucleotide
agactcacgcgtgagtct

SEQ ID NO: 10300 - DNA, 18 bp, Artificial Sequence
  Description of Artificial Sequence: Synthetic oligonucleotide
tgactcacgcgtgagtca

SEQ ID NO: 10301 - DNA, 18 bp, Artificial Sequence
  Description of Artificial Sequence: Synthetic oligonucleotide
cgactcacgcgtgagtcg

SEQ ID NO: 10302 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcagatctgagtcn

SEQ ID NO: 10303 - DNA, 18 bp, Artificial Sequence
  Description of Artificial Sequence: Synthetic oligonucleotide
ggactcagatctgagtcc

SEQ ID NO: 10304 - DNA, 18 bp, Artificial Sequence
  Description of Artificial Sequence: Synthetic oligonucleotide
cgactcagatctgagtcg

SEQ ID NO: 10305 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcttgcaagagtcn

SEQ ID NO: 10306 - DNA, 18 bp, Artificial Sequence
  Description of Artificial Sequence: Synthetic oligonucleotide
ggactcttgcaagagtcc

SEQ ID NO: 10307 - DNA, 18 bp, Artificial Sequence
  Description of Artificial Sequence: Synthetic oligonucleotide
cgactcttgcaagagtcg

SEQ ID NO: 10308 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctacgtagagtcn

SEQ ID NO: 10309 - DNA, 18 bp, Artificial Sequence
  Description of Artificial Sequence: Synthetic oligonucleotide
ggactctacgtagagtcc

SEQ ID NO: 10310 - DNA, 18 bp, Artificial Sequence
  Description of Artificial Sequence: Synthetic oligonucleotide
cgactctacgtagagtcg

SEQ ID NO: 10311 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgctagcgagtcn

SEQ ID NO: 10312 - DNA, 18 bp, Artificial Sequence
  Description of Artificial Sequence: Synthetic oligonucleotide
ggactcgctagcgagtcc

SEQ ID NO: 10313 - DNA, 18 bp, Artificial Sequence
  Description of Artificial Sequence: Synthetic oligonucleotide
agactcgctagcgagtct

SEQ ID NO: 10314 - DNA, 18 bp, Artificial Sequence
  Description of Artificial Sequence: Synthetic oligonucleotide
tgactcgctagcgagtca

SEQ ID NO: 10315 - DNA, 18 bp, Artificial Sequence
  Description of Artificial Sequence: Synthetic oligonucleotide
cgactcgctagcgagtcg

SEQ ID NO: 10316 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctcgcgagagtcn

SEQ ID NO: 10317 - DNA, 18 bp, Artificial Sequence
  Description of Artificial Sequence: Synthetic oligonucleotide
ggactctcgcgagagtcc

SEQ ID NO: 10318 - DNA, 18 bp, Artificial Sequence
  Description of Artificial Sequence: Synthetic oligonucleotide
agactctcgcgagagtct

SEQ ID NO: 10319 - DNA, 18 bp, Artificial Sequence
  Description of Artificial Sequence: Synthetic oligonucleotide
tgactctcgcgagagtca

SEQ ID NO: 10320 - DNA, 18 bp, Artificial Sequence
  Description of Artificial Sequence: Synthetic oligonucleotide
cgactctcgcgagagtcg

SEQ ID NO: 10321 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccacgtggagtcn

SEQ ID NO: 10322 - DNA, 18 bp, Artificial Sequence
  Description of Artificial Sequence: Synthetic oligonucleotide
ggactccacgtggagtcc

SEQ ID NO: 10323 - DNA, 18 bp, Artificial Sequence
  Description of Artificial Sequence: Synthetic oligonucleotide
agactccacgtggagtct

SEQ ID NO: 10324 - DNA, 18 bp, Artificial Sequence
  Description of Artificial Sequence: Synthetic oligonucleotide
tgactccacgtggagtca

SEQ ID NO: 10325 - DNA, 18 bp, Artificial Sequence
  Description of Artificial Sequence: Synthetic oligonucleotide
cgactccacgtggagtcg

SEQ ID NO: 10326 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctccggagagtcn

SEQ ID NO: 10327 - DNA, 18 bp, Artificial Sequence
  Description of Artificial Sequence: Synthetic oligonucleotide
ggactctccggagagtcc

SEQ ID NO: 10328 - DNA, 18 bp, Artificial Sequence
  Description of Artificial Sequence: Synthetic oligonucleotide
agactctccggagagtct

SEQ ID NO: 10329 - DNA, 18 bp, Artificial Sequence
  Description of Artificial Sequence: Synthetic oligonucleotide
tgactctccggagagtca

SEQ ID NO: 10330 - DNA, 18 bp, Artificial Sequence
  Description of Artificial Sequence: Synthetic oligonucleotide
cgactctccggagagtcg

SEQ ID NO: 10331 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgggcccgagtcn

SEQ ID NO: 10332 - DNA, 18 bp, Artificial Sequence
  Description of Artificial Sequence: Synthetic oligonucleotide
ggactcgggcccgagtcc

SEQ ID NO: 10333 - DNA, 18 bp, Artificial Sequence
  Description of Artificial Sequence: Synthetic oligonucleotide
agactcgggcccgagtct

SEQ ID NO: 10334 - DNA, 18 bp, Artificial Sequence
  Description of Artificial Sequence: Synthetic oligonucleotide
tgactcgggcccgagtca

SEQ ID NO: 10335 - DNA, 18 bp, Artificial Sequence
  Description of Artificial Sequence: Synthetic oligonucleotide
cgactcgggcccgagtcg

SEQ ID NO: 10336 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgtatacgagtcn

SEQ ID NO: 10337 - DNA, 18 bp, Artificial Sequence
  Description of Artificial Sequence: Synthetic oligonucleotide
ggactcgtatacgagtcc

SEQ ID NO: 10338 - DNA, 18 bp, Artificial Sequence
  Description of Artificial Sequence: Synthetic oligonucleotide
cgactcgtatacgagtcg

SEQ ID NO: 10339 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccttaaggagtcn

SEQ ID NO: 10340 - DNA, 18 bp, Artificial Sequence
  Description of Artificial Sequence: Synthetic oligonucleotide
ggactccttaaggagtcc

SEQ ID NO: 10341 - DNA, 18 bp, Artificial Sequence
  Description of Artificial Sequence: Synthetic oligonucleotide
cgactccttaaggagtcg

SEQ ID NO: 10342 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcatcgatgagtcn

SEQ ID NO: 10343 - DNA, 18 bp, Artificial Sequence
  Description of Artificial Sequence: Synthetic oligonucleotide
ggactcatcgatgagtcc

SEQ ID NO: 10344 - DNA, 18 bp, Artificial Sequence
  Description of Artificial Sequence: Synthetic oligonucleotide
cgactcatcgatgagtcg

SEQ ID NO: 10345 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcggatccgagtcn

SEQ ID NO: 10346 - DNA, 18 bp, Artificial Sequence
  Description of Artificial Sequence: Synthetic oligonucleotide
ggactcggatccgagtcc

SEQ ID NO: 10347 - DNA, 18 bp, Artificial Sequence
  Description of Artificial Sequence: Synthetic oligonucleotide
agactcggatccgagtct

SEQ ID NO: 10348 - DNA, 18 bp, Artificial Sequence
  Description of Artificial Sequence: Synthetic oligonucleotide
tgactcggatccgagtca

SEQ ID NO: 10349 - DNA, 18 bp, Artificial Sequence
  Description of Artificial Sequence: Synthetic oligonucleotide
cgactcggatccgagtcg

SEQ ID NO: 10350 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcccgcgggagtcn

SEQ ID NO: 10351 - DNA, 18 bp, Artificial Sequence
  Description of Artificial Sequence: Synthetic oligonucleotide
ggactcccgcgggagtcc

SEQ ID NO: 10352 - DNA, 18 bp, Artificial Sequence
  Description of Artificial Sequence: Synthetic oligonucleotide
agactcccgcgggagtct

SEQ ID NO: 10353 - DNA, 18 bp, Artificial Sequence
  Description of Artificial Sequence: Synthetic oligonucleotide
tgactcccgcgggagtca

SEQ ID NO: 10354 - DNA, 18 bp, Artificial Sequence
  Description of Artificial Sequence: Synthetic oligonucleotide
cgactcccgcgggagtcg

SEQ ID NO: 10355 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctgcgcagagtcn

SEQ ID NO: 10356 - DNA, 18 bp, Artificial Sequence
  Description of Artificial Sequence: Synthetic oligonucleotide
ggactctgcgcagagtcc

SEQ ID NO: 10357 - DNA, 18 bp, Artificial Sequence
  Description of Artificial Sequence: Synthetic oligonucleotide
agactctgcgcagagtct

SEQ ID NO: 10358 - DNA, 18 bp, Artificial Sequence
  Description of Artificial Sequence: Synthetic oligonucleotide
tgactctgcgcagagtca

SEQ ID NO: 10359 - DNA, 18 bp, Artificial Sequence
  Description of Artificial Sequence: Synthetic oligonucleotide
cgactctgcgcagagtcg

SEQ ID NO: 10360 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccggccggagtcn

SEQ ID NO: 10361 - DNA, 18 bp, Artificial Sequence
  Description of Artificial Sequence: Synthetic oligonucleotide
ggactccggccggagtcc

SEQ ID NO: 10362 - DNA, 18 bp, Artificial Sequence
  Description of Artificial Sequence: Synthetic oligonucleotide
agactccggccggagtct

SEQ ID NO: 10363 - DNA, 18 bp, Artificial Sequence
  Description of Artificial Sequence: Synthetic oligonucleotide
tgactccggccggagtca

SEQ ID NO: 10364 - DNA, 18 bp, Artificial Sequence
  Description of Artificial Sequence: Synthetic oligonucleotide
cgactccggccggagtcg

SEQ ID NO: 10365 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctggccagagtcn

SEQ ID NO: 10366 - DNA, 18 bp, Artificial Sequence
  Description of Artificial Sequence: Synthetic oligonucleotide
ggactctggccagagtcc

SEQ ID NO: 10367 - DNA, 18 bp, Artificial Sequence
  Description of Artificial Sequence: Synthetic oligonucleotide
agactctggccagagtct

SEQ ID NO: 10368 - DNA, 18 bp, Artificial Sequence
  Description of Artificial Sequence: Synthetic oligonucleotide
tgactctggccagagtca

SEQ ID NO: 10369 - DNA, 18 bp, Artificial Sequence
  Description of Artificial Sequence: Synthetic oligonucleotide
cgactctggccagagtcg

SEQ ID NO: 10370 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcaagcttgagtcn

SEQ ID NO: 10371 - DNA, 18 bp, Artificial Sequence
  Description of Artificial Sequence: Synthetic oligonucleotide
ggactcaagcttgagtcc

SEQ ID NO: 10372 - DNA, 18 bp, Artificial Sequence
  Description of Artificial Sequence: Synthetic oligonucleotide
cgactcaagcttgagtcg

SEQ ID NO: 10373 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctgatcagagtcn

SEQ ID NO: 10374 - DNA, 18 bp, Artificial Sequence
  Description of Artificial Sequence: Synthetic oligonucleotide
ggactctgatcagagtcc

SEQ ID NO: 10375 - DNA, 18 bp, Artificial Sequence
  Description of Artificial Sequence: Synthetic oligonucleotide
cgactctgatcagagtcg

SEQ ID NO: 10376 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccaattggagtcn

SEQ ID NO: 10377 - DNA, 18 bp, Artificial Sequence
  Description of Artificial Sequence: Synthetic oligonucleotide
ggactccaattggagtcc

SEQ ID NO: 10378 - DNA, 18 bp, Artificial Sequence
  Description of Artificial Sequence: Synthetic oligonucleotide
cgactccaattggagtcg

SEQ ID NO: 10379 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcccatgggagtcn

SEQ ID NO: 10380 - DNA, 18 bp, Artificial Sequence
  Description of Artificial Sequence: Synthetic oligonucleotide
ggactcccatgggagtcc

SEQ ID NO: 10381 - DNA, 18 bp, Artificial Sequence
  Description of Artificial Sequence: Synthetic oligonucleotide
agactcccatgggagtct

SEQ ID NO: 10382 - DNA, 18 bp, Artificial Sequence
  Description of Artificial Sequence: Synthetic oligonucleotide
tgactcccatgggagtca

SEQ ID NO: 10383 - DNA, 18 bp, Artificial Sequence
  Description of Artificial Sequence: Synthetic oligonucleotide
cgactcccatgggagtcg

SEQ ID NO: 10384 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcaggcctgagtcn

SEQ ID NO: 10385 - DNA, 18 bp, Artificial Sequence
  Description of Artificial Sequence: Synthetic oligonucleotide
ggactcaggcctgagtcc

SEQ ID NO: 10386 - DNA, 18 bp, Artificial Sequence
  Description of Artificial Sequence: Synthetic oligonucleotide
agactcaggcctgagtct

SEQ ID NO: 10387 - DNA, 18 bp, Artificial Sequence
  Description of Artificial Sequence: Synthetic oligonucleotide
tgactcaggcctgagtca

SEQ ID NO: 10388 - DNA, 18 bp, Artificial Sequence
  Description of Artificial Sequence: Synthetic oligonucleotide
cgactcaggcctgagtcg

SEQ ID NO: 10389 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgccggcgagtcn

SEQ ID NO: 10390 - DNA, 18 bp, Artificial Sequence
  Description of Artificial Sequence: Synthetic oligonucleotide
ggactcgccggcgagtcc

SEQ ID NO: 10391 - DNA, 18 bp, Artificial Sequence
  Description of Artificial Sequence: Synthetic oligonucleotide
agactcgccggcgagtct

SEQ ID NO: 10392 - DNA, 18 bp, Artificial Sequence
  Description of Artificial Sequence: Synthetic oligonucleotide
tgactcgccggcgagtca

SEQ ID NO: 10393 - DNA, 18 bp, Artificial Sequence
  Description of Artificial Sequence: Synthetic oligonucleotide
cgactcgccggcgagtcg

SEQ ID NO: 10394 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactccgcgcggagtcn

SEQ ID NO: 10395 - DNA, 18 bp, Artificial Sequence
  Description of Artificial Sequence: Synthetic oligonucleotide
ggactccgcgcggagtcc

SEQ ID NO: 10396 - DNA, 18 bp, Artificial Sequence
  Description of Artificial Sequence: Synthetic oligonucleotide
agactccgcgcggagtct

SEQ ID NO: 10397 - DNA, 18 bp, Artificial Sequence
  Description of Artificial Sequence: Synthetic oligonucleotide
tgactccgcgcggagtca

SEQ ID NO: 10398 - DNA, 18 bp, Artificial Sequence
  Description of Artificial Sequence: Synthetic oligonucleotide
cgactccgcgcggagtcg

SEQ ID NO: 10399 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcgcgcgcgagtcn

SEQ ID NO: 10400 - DNA, 18 bp, Artificial Sequence
  Description of Artificial Sequence: Synthetic oligonucleotide
ggactcgcgcgcgagtcc

SEQ ID NO: 10401 - DNA, 18 bp, Artificial Sequence
  Description of Artificial Sequence: Synthetic oligonucleotide
agactcgcgcgcgagtct

SEQ ID NO: 10402 - DNA, 18 bp, Artificial Sequence
  Description of Artificial Sequence: Synthetic oligonucleotide
tgactcgcgcgcgagtca

SEQ ID NO: 10403 - DNA, 18 bp, Artificial Sequence
  Description of Artificial Sequence: Synthetic oligonucleotide
cgactcgcgcgcgagtcg

SEQ ID NO: 10404 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactctcatgagagtcn

SEQ ID NO: 10405 - DNA, 18 bp, Artificial Sequence
  Description of Artificial Sequence: Synthetic oligonucleotide
ggactctcatgagagtcc

SEQ ID NO: 10406 - DNA, 18 bp, Artificial Sequence
  Description of Artificial Sequence: Synthetic oligonucleotide
cgactctcatgagagtcg

SEQ ID NO: 10407 - DNA, 18 bp, Artificial Sequence
  Description of Artificial Sequence: Synthetic oligonucleotide
  modified_base (1)..(1): a, c, t, or g
  modified_base (18)..(18): a, c, t, or g
ngactcttcgaagagtcn

SEQ ID NO: 10408 - DNA, 18 bp, Artificial Sequence
  Description of Artificial Sequence: Synthetic oligonucleotide
ggactcttcgaagagtcc

SEQ ID NO: 10409 - DNA, 18 bp, Artificial Sequence
  Description of Artificial Sequence: Synthetic oligonucleotide
cgactcttcgaagagtcg

SEQ ID NO: 10410 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactccgcggagtcnnnn

SEQ ID NO: 10411 - DNA, 22 bp, Artificial Sequence
  Description of Artificial Sequence: Synthetic oligonucleotide
ggcggactccgcggagtccgcc

SEQ ID NO: 10412 - DNA, 22 bp, Artificial Sequence
  Description of Artificial Sequence: Synthetic oligonucleotide
agcggactccgcggagtccgct

SEQ ID NO: 10413 - DNA, 22 bp, Artificial Sequence
  Description of Artificial Sequence: Synthetic oligonucleotide
gacggactccgcggagtccgtc

SEQ ID NO: 10414 - DNA, 22 bp, Artificial Sequence
  Description of Artificial Sequence: Synthetic oligonucleotide
ggaggactccgcggagtcctcc

SEQ ID NO: 10415 - DNA, 22 bp, Artificial Sequence
  Description of Artificial Sequence: Synthetic oligonucleotide
ggcagactccgcggagtctgcc

SEQ ID NO: 10416 - DNA, 22 bp, Artificial Sequence
  Description of Artificial Sequence: Synthetic oligonucleotide
tgcggactccgcggagtccgca

SEQ ID NO: 10417 - DNA, 22 bp, Artificial Sequence
  Description of Artificial Sequence: Synthetic oligonucleotide
gtcggactccgcggagtccgac

SEQ ID NO: 10418 - DNA, 22 bp, Artificial Sequence
  Description of Artificial Sequence: Synthetic oligonucleotide
ggtggactccgcggagtccacc

SEQ ID NO: 10419 - DNA, 22 bp, Artificial Sequence
  Description of Artificial Sequence: Synthetic oligonucleotide
ggctgactccgcggagtcagcc

SEQ ID NO: 10420 - DNA, 22 bp, Artificial Sequence
  Description of Artificial Sequence: Synthetic oligonucleotide
gcccgactccgcggagtcgggc

SEQ ID NO: 10421 - DNA, 22 bp, Artificial Sequence
  Description of Artificial Sequence: Synthetic oligonucleotide
acccgactccgcggagtcgggt

SEQ ID NO: 10422 - DNA, 22 bp, Artificial Sequence
  Description of Artificial Sequence: Synthetic oligonucleotide
gaccgactccgcggagtcggtc

SEQ ID NO: 10423 - DNA, 22 bp, Artificial Sequence
  Description of Artificial Sequence: Synthetic oligonucleotide
gcacgactccgcggagtcgtgc

SEQ ID NO: 10424 - DNA, 22 bp, Artificial Sequence
  Description of Artificial Sequence: Synthetic oligonucleotide
gccagactccgcggagtctggc

SEQ ID NO: 10425 - DNA, 22 bp, Artificial Sequence
  Description of Artificial Sequence: Synthetic oligonucleotide
tcccgactccgcggagtcggga

SEQ ID NO: 10426 - DNA, 22 bp, Artificial Sequence
  Description of Artificial Sequence: Synthetic oligonucleotide
gtccgactccgcggagtcggac

SEQ ID NO: 10427 - DNA, 22 bp, Artificial Sequence
  Description of Artificial Sequence: Synthetic oligonucleotide
gcctgactccgcggagtcaggc

SEQ ID NO: 10428 - DNA, 22 bp, Artificial Sequence
  Description of Artificial Sequence: Synthetic oligonucleotide
gggcgactccgcggagtcgccc

SEQ ID NO: 10429 - DNA, 22 bp, Artificial Sequence
  Description of Artificial Sequence: Synthetic oligonucleotide
aggcgactccgcggagtcgcct

SEQ ID NO: 10430 - DNA, 22 bp, Artificial Sequence
  Description of Artificial Sequence: Synthetic oligonucleotide
gagcgactccgcggagtcgctc

SEQ ID NO: 10431 - DNA, 22 bp, Artificial Sequence
  Description of Artificial Sequence: Synthetic oligonucleotide
ggacgactccgcggagtcgtcc

SEQ ID NO: 10432 - DNA, 22 bp, Artificial Sequence
  Description of Artificial Sequence: Synthetic oligonucleotide
gggagactccgcggagtctccc

SEQ ID NO: 10433 - DNA, 22 bp, Artificial Sequence
  Description of Artificial Sequence: Synthetic oligonucleotide
tggcgactccgcggagtcgcca

SEQ ID NO: 10434 - DNA, 22 bp, Artificial Sequence
  Description of Artificial Sequence: Synthetic oligonucleotide
gtgcgactccgcggagtcgcac

SEQ ID NO: 10435 - DNA, 22 bp, Artificial Sequence
  Description of Artificial Sequence: Synthetic oligonucleotide
gggtgactccgcggagtcaccc

SEQ ID NO: 10436 - DNA, 22 bp, Artificial Sequence
  Description of Artificial Sequence: Synthetic oligonucleotide
acgggactccgcggagtcccgt

SEQ ID NO: 10437 - DNA, 22 bp, Artificial Sequence
  Description of Artificial Sequence: Synthetic oligonucleotide
cagggactccgcggagtccctg

SEQ ID NO: 10438 - DNA, 22 bp, Artificial Sequence
  Description of Artificial Sequence: Synthetic oligonucleotide
ccaggactccgcggagtcctgg

SEQ ID NO: 10439 - DNA, 22 bp, Artificial Sequence
  Description of Artificial Sequence: Synthetic oligonucleotide
ccgagactccgcggagtctcgg

SEQ ID NO: 10440 - DNA, 22 bp, Artificial Sequence
  Description of Artificial Sequence: Synthetic oligonucleotide
tcgggactccgcggagtcccga

SEQ ID NO: 10441 - DNA, 22 bp, Artificial Sequence
  Description of Artificial Sequence: Synthetic oligonucleotide
ctgggactccgcggagtcccag

SEQ ID NO: 10442 - DNA, 22 bp, Artificial Sequence
  Description of Artificial Sequence: Synthetic oligonucleotide
cctggactccgcggagtccagg

SEQ ID NO: 10443 - DNA, 22 bp, Artificial Sequence
  Description of Artificial Sequence: Synthetic oligonucleotide
ccgtgactccgcggagtcacgg

SEQ ID NO: 10444 - DNA, 22 bp, Artificial Sequence
  Description of Artificial Sequence: Synthetic oligonucleotide
cggcgactccgcggagtcgccg

SEQ ID NO: 10445 - DNA, 22 bp, Artificial Sequence
  Description of Artificial Sequence: Synthetic oligonucleotide
cagcgactccgcggagtcgctg

SEQ ID NO: 10446 - DNA, 22 bp, Artificial Sequence
  Description of Artificial Sequence: Synthetic oligonucleotide
cgacgactccgcggagtcgtcg

SEQ ID NO: 10447 - DNA, 22 bp, Artificial Sequence
  Description of Artificial Sequence: Synthetic oligonucleotide
cggagactccgcggagtctccg

SEQ ID NO: 10448 - DNA, 22 bp, Artificial Sequence
  Description of Artificial Sequence: Synthetic oligonucleotide
ctgcgactccgcggagtcgcag

SEQ ID NO: 10449 - DNA, 22 bp, Artificial Sequence
  Description of Artificial Sequence: Synthetic oligonucleotide
cggtgactccgcggagtcaccg

SEQ ID NO: 10450 - DNA, 22 bp, Artificial Sequence
  Description of Artificial Sequence: Synthetic oligonucleotide
cacggactccgcggagtccgtg

SEQ ID NO: 10451 - DNA, 22 bp, Artificial Sequence
  Description of Artificial Sequence: Synthetic oligonucleotide
cccagactccgcggagtctggg

SEQ ID NO: 10452 - DNA, 22 bp, Artificial Sequence
  Description of Artificial Sequence: Synthetic oligonucleotide
ctcggactccgcggagtccgag

SEQ ID NO: 10453 - DNA, 22 bp, Artificial Sequence
  Description of Artificial Sequence: Synthetic oligonucleotide
ccctgactccgcggagtcaggg

SEQ ID NO: 10454 - DNA, 22 bp, Artificial Sequence
  Description of Artificial Sequence: Synthetic oligonucleotide
ccacgactccgcggagtcgtgg

SEQ ID NO: 10455 - DNA, 22 bp, Artificial Sequence
  Description of Artificial Sequence: Synthetic oligonucleotide
agccgactccgcggagtcggct

SEQ ID NO: 10456 - DNA, 22 bp, Artificial Sequence
  Description of Artificial Sequence: Synthetic oligonucleotide
tgccgactccgcggagtcggca

SEQ ID NO: 10457 - DNA, 22 bp, Artificial Sequence
  Description of Artificial Sequence: Synthetic oligonucleotide
gcgagactccgcggagtctcgc

SEQ ID NO: 10458 - DNA, 22 bp, Artificial Sequence
  Description of Artificial Sequence: Synthetic oligonucleotide
gcgtgactccgcggagtcacgc

SEQ ID NO: 10459 - DNA, 22 bp, Artificial Sequence
  Description of Artificial Sequence: Synthetic oligonucleotide
gcaggactccgcggagtcctgc

SEQ ID NO: 10460 - DNA, 22 bp, Artificial Sequence
  Description of Artificial Sequence: Synthetic oligonucleotide
gctggactccgcggagtccagc

SEQ ID NO: 10461 - DNA, 22 bp, Artificial Sequence
  Description of Artificial Sequence: Synthetic oligonucleotide
cgaggactccgcggagtcctcg

SEQ ID NO: 10462 - DNA, 22 bp, Artificial Sequence
  Description of Artificial Sequence: Synthetic oligonucleotide
cgtggactccgcggagtccacg

SEQ ID NO: 10463 - DNA, 22 bp, Artificial Sequence
  Description of Artificial Sequence: Synthetic oligonucleotide
caccgactccgcggagtcggtg

SEQ ID NO: 10464 - DNA, 22 bp, Artificial Sequence
  Description of Artificial Sequence: Synthetic oligonucleotide
ctccgactccgcggagtcggag

SEQ ID NO: 10465 - DNA, 22 bp, Artificial Sequence
  Description of Artificial Sequence: Synthetic oligonucleotide
gcgggactccgcggagtcccgc

SEQ ID NO: 10466 - DNA, 22 bp, Artificial Sequence
  Description of Artificial Sequence: Synthetic oligonucleotide
gagggactccgcggagtccctc

SEQ ID NO: 10467 - DNA, 22 bp, Artificial Sequence
  Description of Artificial Sequence: Synthetic oligonucleotide
gtgggactccgcggagtcccac

SEQ ID NO: 10468 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactctgcagagtcnnnn

SEQ ID NO: 10469 - DNA, 22 bp, Artificial Sequence
  Description of Artificial Sequence: Synthetic oligonucleotide
ggcggactctgcagagtccgcc

SEQ ID NO: 10470 - DNA, 22 bp, Artificial Sequence
  Description of Artificial Sequence: Synthetic oligonucleotide
agcggactctgcagagtccgct

SEQ ID NO: 10471 - DNA, 22 bp, Artificial Sequence
  Description of Artificial Sequence: Synthetic oligonucleotide
gacggactctgcagagtccgtc

SEQ ID NO: 10472 - DNA, 22 bp, Artificial Sequence
  Description of Artificial Sequence: Synthetic oligonucleotide
ggaggactctgcagagtcctcc

SEQ ID NO: 10473 - DNA, 22 bp, Artificial Sequence
  Description of Artificial Sequence: Synthetic oligonucleotide
ggcagactctgcagagtctgcc

SEQ ID NO: 10474 - DNA, 22 bp, Artificial Sequence
  Description of Artificial Sequence: Synthetic oligonucleotide
tgcggactctgcagagtccgca

SEQ ID NO: 10475 - DNA, 22 bp, Artificial Sequence
  Description of Artificial Sequence: Synthetic oligonucleotide
gtcggactctgcagagtccgac

SEQ ID NO: 10476 - DNA, 22 bp, Artificial Sequence
  Description of Artificial Sequence: Synthetic oligonucleotide
ggtggactctgcagagtccacc

SEQ ID NO: 10477 - DNA, 22 bp, Artificial Sequence
  Description of Artificial Sequence: Synthetic oligonucleotide
ggctgactctgcagagtcagcc

SEQ ID NO: 10478 - DNA, 22 bp, Artificial Sequence
  Description of Artificial Sequence: Synthetic oligonucleotide
gcccgactctgcagagtcgggc

SEQ ID NO: 10479 - DNA, 22 bp, Artificial Sequence
  Description of Artificial Sequence: Synthetic oligonucleotide
acccgactctgcagagtcgggt

SEQ ID NO: 10480 - DNA, 22 bp, Artificial Sequence
  Description of Artificial Sequence: Synthetic oligonucleotide
gaccgactctgcagagtcggtc

SEQ ID NO: 10481 - DNA, 22 bp, Artificial Sequence
  Description of Artificial Sequence: Synthetic oligonucleotide
gcacgactctgcagagtcgtgc

SEQ ID NO: 10482 - DNA, 22 bp, Artificial Sequence
  Description of Artificial Sequence: Synthetic oligonucleotide
gccagactctgcagagtctggc

SEQ ID NO: 10483 - DNA, 22 bp, Artificial Sequence
  Description of Artificial Sequence: Synthetic oligonucleotide
tcccgactctgcagagtcggga

SEQ ID NO: 10484 - DNA, 22 bp, Artificial Sequence
  Description of Artificial Sequence: Synthetic oligonucleotide
gtccgactctgcagagtcggac

SEQ ID NO: 10485 - DNA, 22 bp, Artificial Sequence
  Description of Artificial Sequence: Synthetic oligonucleotide
gcctgactctgcagagtcaggc

SEQ ID NO: 10486 - DNA, 22 bp, Artificial Sequence
  Description of Artificial Sequence: Synthetic oligonucleotide
gggcgactctgcagagtcgccc

SEQ ID NO: 10487 - DNA, 22 bp, Artificial Sequence
  Description of Artificial Sequence: Synthetic oligonucleotide
aggcgactctgcagagtcgcct

SEQ ID NO: 10488 - DNA, 22 bp, Artificial Sequence
  Description of Artificial Sequence: Synthetic oligonucleotide
gagcgactctgcagagtcgctc

SEQ ID NO: 10489 - DNA, 22 bp, Artificial Sequence
  Description of Artificial Sequence: Synthetic oligonucleotide
ggacgactctgcagagtcgtcc

SEQ ID NO: 10490 - DNA, 22 bp, Artificial Sequence
  Description of Artificial Sequence: Synthetic oligonucleotide
gggagactctgcagagtctccc

SEQ ID NO: 10491 - DNA, 22 bp, Artificial Sequence
  Description of Artificial Sequence: Synthetic oligonucleotide
tggcgactctgcagagtcgcca

SEQ ID NO: 10492 - DNA, 22 bp, Artificial Sequence
  Description of Artificial Sequence: Synthetic oligonucleotide
gtgcgactctgcagagtcgcac

SEQ ID NO: 10493 - DNA, 22 bp, Artificial Sequence
  Description of Artificial Sequence: Synthetic oligonucleotide
gggtgactctgcagagtcaccc

SEQ ID NO: 10494 - DNA, 22 bp, Artificial Sequence
  Description of Artificial Sequence: Synthetic oligonucleotide
acgggactctgcagagtcccgt

SEQ ID NO: 10495 - DNA, 22 bp, Artificial Sequence
  Description of Artificial Sequence: Synthetic oligonucleotide
cagggactctgcagagtccctg

SEQ ID NO: 10496 - DNA, 22 bp, Artificial Sequence
  Description of Artificial Sequence: Synthetic oligonucleotide
ccaggactctgcagagtcctgg

SEQ ID NO: 10497 - DNA, 22 bp, Artificial Sequence
  Description of Artificial Sequence: Synthetic oligonucleotide
ccgagactctgcagagtctcgg

SEQ ID NO: 10498 - DNA, 22 bp, Artificial Sequence
  Description of Artificial Sequence: Synthetic oligonucleotide
tcgggactctgcagagtcccga

SEQ ID NO: 10499 - DNA, 22 bp, Artificial Sequence
  Description of Artificial Sequence: Synthetic oligonucleotide
ctgggactctgcagagtcccag

SEQ ID NO: 10500 - DNA, 22 bp, Artificial Sequence
  Description of Artificial Sequence: Synthetic oligonucleotide
cctggactctgcagagtccagg

SEQ ID NO: 10501 - DNA, 22 bp, Artificial Sequence
  Description of Artificial Sequence: Synthetic oligonucleotide
ccgtgactctgcagagtcacgg

SEQ ID NO: 10502 - DNA, 22 bp, Artificial Sequence
  Description of Artificial Sequence: Synthetic oligonucleotide
cggcgactctgcagagtcgccg

SEQ ID NO: 10503 - DNA, 22 bp, Artificial Sequence
  Description of Artificial Sequence: Synthetic oligonucleotide
cagcgactctgcagagtcgctg

SEQ ID NO: 10504 - DNA, 22 bp, Artificial Sequence
  Description of Artificial Sequence: Synthetic oligonucleotide
cgacgactctgcagagtcgtcg

SEQ ID NO: 10505 - DNA, 22 bp, Artificial Sequence
  Description of Artificial Sequence: Synthetic oligonucleotide
cggagactctgcagagtctccg

SEQ ID NO: 10506 - DNA, 22 bp, Artificial Sequence
  Description of Artificial Sequence: Synthetic oligonucleotide
ctgcgactctgcagagtcgcag

SEQ ID NO: 10507 - DNA, 22 bp, Artificial Sequence
  Description of Artificial Sequence: Synthetic oligonucleotide
cggtgactctgcagagtcaccg

SEQ ID NO: 10508 - DNA, 22 bp, Artificial Sequence
  Description of Artificial Sequence: Synthetic oligonucleotide
cacggactctgcagagtccgtg

SEQ ID NO: 10509 - DNA, 22 bp, Artificial Sequence
  Description of Artificial Sequence: Synthetic oligonucleotide
cccagactctgcagagtctggg

SEQ ID NO: 10510 - DNA, 22 bp, Artificial Sequence
  Description of Artificial Sequence: Synthetic oligonucleotide
ctcggactctgcagagtccgag

SEQ ID NO: 10511 - DNA, 22 bp, Artificial Sequence
  Description of Artificial Sequence: Synthetic oligonucleotide
ccctgactctgcagagtcaggg

SEQ ID NO: 10512 - DNA, 22 bp, Artificial Sequence
  Description of Artificial Sequence: Synthetic oligonucleotide
ccacgactctgcagagtcgtgg

SEQ ID NO: 10513 - DNA, 22 bp, Artificial Sequence
  Description of Artificial Sequence: Synthetic oligonucleotide
agccgactctgcagagtcggct

SEQ ID NO: 10514 - DNA, 22 bp, Artificial Sequence
  Description of Artificial Sequence: Synthetic oligonucleotide
tgccgactctgcagagtcggca

SEQ ID NO: 10515 - DNA, 22 bp, Artificial Sequence
  Description of Artificial Sequence: Synthetic oligonucleotide
gcgagactctgcagagtctcgc

SEQ ID NO: 10516 - DNA, 22 bp, Artificial Sequence
  Description of Artificial Sequence: Synthetic oligonucleotide
gcgtgactctgcagagtcacgc

SEQ ID NO: 10517 - DNA, 22 bp, Artificial Sequence
  Description of Artificial Sequence: Synthetic oligonucleotide
gcaggactctgcagagtcctgc

SEQ ID NO: 10518 - DNA, 22 bp, Artificial Sequence
  Description of Artificial Sequence: Synthetic oligonucleotide
gctggactctgcagagtccagc

SEQ ID NO: 10519 - DNA, 22 bp, Artificial Sequence
  Description of Artificial Sequence: Synthetic oligonucleotide
cgaggactctgcagagtcctcg

SEQ ID NO: 10520 - DNA, 22 bp, Artificial Sequence
  Description of Artificial Sequence: Synthetic oligonucleotide
cgtggactctgcagagtccacg

SEQ ID NO: 10521 - DNA, 22 bp, Artificial Sequence
  Description of Artificial Sequence: Synthetic oligonucleotide
caccgactctgcagagtcggtg

SEQ ID NO: 10522 - DNA, 22 bp, Artificial Sequence
  Description of Artificial Sequence: Synthetic oligonucleotide
ctccgactctgcagagtcggag

SEQ ID NO: 10523 - DNA, 22 bp, Artificial Sequence
  Description of Artificial Sequence: Synthetic oligonucleotide
gcgggactctgcagagtcccgc

SEQ ID NO: 10524 - DNA, 22 bp, Artificial Sequence
  Description of Artificial Sequence: Synthetic oligonucleotide
gagggactctgcagagtccctc

SEQ ID NO: 10525 - DNA, 22 bp, Artificial Sequence
  Description of Artificial Sequence: Synthetic oligonucleotide
gtgggactctgcagagtcccac

SEQ ID NO: 10526 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcgcgcgagtcnnnn

SEQ ID NO: 10527 - DNA, 22 bp, Artificial Sequence
  Description of Artificial Sequence: Synthetic oligonucleotide
ggcggactcgcgcgagtccgcc

SEQ ID NO: 10528 - DNA, 22 bp, Artificial Sequence
  Description of Artificial Sequence: Synthetic oligonucleotide
agcggactcgcgcgagtccgct

SEQ ID NO: 10529 - DNA, 22 bp, Artificial Sequence
  Description of Artificial Sequence: Synthetic oligonucleotide
gacggactcgcgcgagtccgtc

SEQ ID NO: 10530 - DNA, 22 bp, Artificial Sequence
  Description of Artificial Sequence: Synthetic oligonucleotide
ggaggactcgcgcgagtcctcc

SEQ ID NO: 10531 - DNA, 22 bp, Artificial Sequence
  Description of Artificial Sequence: Synthetic oligonucleotide
ggcagactcgcgcgagtctgcc

SEQ ID NO: 10532 - DNA, 22 bp, Artificial Sequence
  Description of Artificial Sequence: Synthetic oligonucleotide
tgcggactcgcgcgagtccgca

SEQ ID NO: 10533 - DNA, 22 bp, Artificial Sequence
  Description of Artificial Sequence: Synthetic oligonucleotide
gtcggactcgcgcgagtccgac

SEQ ID NO: 10534 - DNA, 22 bp, Artificial Sequence
  Description of Artificial Sequence: Synthetic oligonucleotide
ggtggactcgcgcgagtccacc

SEQ ID NO: 10535 - DNA, 22 bp, Artificial Sequence
  Description of Artificial Sequence: Synthetic oligonucleotide
ggctgactcgcgcgagtcagcc

SEQ ID NO: 10536 - DNA, 22 bp, Artificial Sequence
  Description of Artificial Sequence: Synthetic oligonucleotide
gcccgactcgcgcgagtcgggc

SEQ ID NO: 10537 - DNA, 22 bp, Artificial Sequence
  Description of Artificial Sequence: Synthetic oligonucleotide
acccgactcgcgcgagtcgggt

SEQ ID NO: 10538 - DNA, 22 bp, Artificial Sequence
  Description of Artificial Sequence: Synthetic oligonucleotide
gaccgactcgcgcgagtcggtc

SEQ ID NO: 10539 - DNA, 22 bp, Artificial Sequence
  Description of Artificial Sequence: Synthetic oligonucleotide
gcacgactcgcgcgagtcgtgc

SEQ ID NO: 10540 - DNA, 22 bp, Artificial Sequence
  Description of Artificial Sequence: Synthetic oligonucleotide
gccagactcgcgcgagtctggc

SEQ ID NO: 10541 - DNA, 22 bp, Artificial Sequence
  Description of Artificial Sequence: Synthetic oligonucleotide
tcccgactcgcgcgagtcggga

SEQ ID NO: 10542 - DNA, 22 bp, Artificial Sequence
  Description of Artificial Sequence: Synthetic oligonucleotide
gtccgactcgcgcgagtcggac

SEQ ID NO: 10543 - DNA, 22 bp, Artificial Sequence
  Description of Artificial Sequence: Synthetic oligonucleotide
gcctgactcgcgcgagtcaggc

SEQ ID NO: 10544 - DNA, 22 bp, Artificial Sequence
  Description of Artificial Sequence: Synthetic oligonucleotide
gggcgactcgcgcgagtcgccc

SEQ ID NO: 10545 - DNA, 22 bp, Artificial Sequence
  Description of Artificial Sequence: Synthetic oligonucleotide
aggcgactcgcgcgagtcgcct

SEQ ID NO: 10546 - DNA, 22 bp, Artificial Sequence
  Description of Artificial Sequence: Synthetic oligonucleotide
gagcgactcgcgcgagtcgctc

SEQ ID NO: 10547 - DNA, 22 bp, Artificial Sequence
  Description of Artificial Sequence: Synthetic oligonucleotide
ggacgactcgcgcgagtcgtcc

SEQ ID NO: 10548 - DNA, 22 bp, Artificial Sequence
  Description of Artificial Sequence: Synthetic oligonucleotide
gggagactcgcgcgagtctccc

SEQ ID NO: 10549 - DNA, 22 bp, Artificial Sequence
  Description of Artificial Sequence: Synthetic oligonucleotide
tggcgactcgcgcgagtcgcca

SEQ ID NO: 10550 - DNA, 22 bp, Artificial Sequence
  Description of Artificial Sequence: Synthetic oligonucleotide
gtgcgactcgcgcgagtcgcac

SEQ ID NO: 10551 - DNA, 22 bp, Artificial Sequence
  Description of Artificial Sequence: Synthetic oligonucleotide
gggtgactcgcgcgagtcaccc

SEQ ID NO: 10552 - DNA, 22 bp, Artificial Sequence
  Description of Artificial Sequence: Synthetic oligonucleotide
acgggactcgcgcgagtcccgt

SEQ ID NO: 10553 - DNA, 22 bp, Artificial Sequence
  Description of Artificial Sequence: Synthetic oligonucleotide
cagggactcgcgcgagtccctg

SEQ ID NO: 10554 - DNA, 22 bp, Artificial Sequence
  Description of Artificial Sequence: Synthetic oligonucleotide
ccaggactcgcgcgagtcctgg

SEQ ID NO: 10555 - DNA, 22 bp, Artificial Sequence
  Description of Artificial Sequence: Synthetic oligonucleotide
ccgagactcgcgcgagtctcgg

SEQ ID NO: 10556 - DNA, 22 bp, Artificial Sequence
  Description of Artificial Sequence: Synthetic oligonucleotide
tcgggactcgcgcgagtcccga

SEQ ID NO: 10557 - DNA, 22 bp, Artificial Sequence
  Description of Artificial Sequence: Synthetic oligonucleotide
ctgggactcgcgcgagtcccag

SEQ ID NO: 10558 - DNA, 22 bp, Artificial Sequence
  Description of Artificial Sequence: Synthetic oligonucleotide
cctggactcgcgcgagtccagg

SEQ ID NO: 10559 - DNA, 22 bp, Artificial Sequence
  Description of Artificial Sequence: Synthetic oligonucleotide
ccgtgactcgcgcgagtcacgg

SEQ ID NO: 10560 - DNA, 22 bp, Artificial Sequence
  Description of Artificial Sequence: Synthetic oligonucleotide
cggcgactcgcgcgagtcgccg

SEQ ID NO: 10561 - DNA, 22 bp, Artificial Sequence
  Description of Artificial Sequence: Synthetic oligonucleotide
cagcgactcgcgcgagtcgctg

SEQ ID NO: 10562 - DNA, 22 bp, Artificial Sequence
  Description of Artificial Sequence: Synthetic oligonucleotide
cgacgactcgcgcgagtcgtcg

SEQ ID NO: 10563 - DNA, 22 bp, Artificial Sequence
  Description of Artificial Sequence: Synthetic oligonucleotide
cggagactcgcgcgagtctccg

SEQ ID NO: 10564 - DNA, 22 bp, Artificial Sequence
  Description of Artificial Sequence: Synthetic oligonucleotide
ctgcgactcgcgcgagtcgcag

SEQ ID NO: 10565 - DNA, 22 bp, Artificial Sequence
  Description of Artificial Sequence: Synthetic oligonucleotide
cggtgactcgcgcgagtcaccg

SEQ ID NO: 10566 - DNA, 22 bp, Artificial Sequence
  Description of Artificial Sequence: Synthetic oligonucleotide
cacggactcgcgcgagtccgtg

SEQ ID NO: 10567 - DNA, 22 bp, Artificial Sequence
  Description of Artificial Sequence: Synthetic oligonucleotide
cccagactcgcgcgagtctggg

SEQ ID NO: 10568 - DNA, 22 bp, Artificial Sequence
  Description of Artificial Sequence: Synthetic oligonucleotide
ctcggactcgcgcgagtccgag

SEQ ID NO: 10569 - DNA, 22 bp, Artificial Sequence
  Description of Artificial Sequence: Synthetic oligonucleotide
ccctgactcgcgcgagtcaggg

SEQ ID NO: 10570 - DNA, 22 bp, Artificial Sequence
  Description of Artificial Sequence: Synthetic oligonucleotide
ccacgactcgcgcgagtcgtgg

SEQ ID NO: 10571 - DNA, 22 bp, Artificial Sequence
  Description of Artificial Sequence: Synthetic oligonucleotide
agccgactcgcgcgagtcggct

SEQ ID NO: 10572 - DNA, 22 bp, Artificial Sequence
  Description of Artificial Sequence: Synthetic oligonucleotide
tgccgactcgcgcgagtcggca

SEQ ID NO: 10573 - DNA, 22 bp, Artificial Sequence
  Description of Artificial Sequence: Synthetic oligonucleotide
gcgagactcgcgcgagtctcgc

SEQ ID NO: 10574 - DNA, 22 bp, Artificial Sequence
  Description of Artificial Sequence: Synthetic oligonucleotide
gcgtgactcgcgcgagtcacgc

SEQ ID NO: 10575 - DNA, 22 bp, Artificial Sequence
  Description of Artificial Sequence: Synthetic oligonucleotide
gcaggactcgcgcgagtcctgc

SEQ ID NO: 10576 - DNA, 22 bp, Artificial Sequence
  Description of Artificial Sequence: Synthetic oligonucleotide
gctggactcgcgcgagtccagc

SEQ ID NO: 10577 - DNA, 22 bp, Artificial Sequence
  Description of Artificial Sequence: Synthetic oligonucleotide
cgaggactcgcgcgagtcctcg

SEQ ID NO: 10578 - DNA, 22 bp, Artificial Sequence
  Description of Artificial Sequence: Synthetic oligonucleotide
cgtggactcgcgcgagtccacg

SEQ ID NO: 10579 - DNA, 22 bp, Artificial Sequence
  Description of Artificial Sequence: Synthetic oligonucleotide
caccgactcgcgcgagtcggtg

SEQ ID NO: 10580 - DNA, 22 bp, Artificial Sequence
  Description of Artificial Sequence: Synthetic oligonucleotide
ctccgactcgcgcgagtcggag

SEQ ID NO: 10581 - DNA, 22 bp, Artificial Sequence
  Description of Artificial Sequence: Synthetic oligonucleotide
gcgggactcgcgcgagtcccgc

SEQ ID NO: 10582 - DNA, 22 bp, Artificial Sequence
  Description of Artificial Sequence: Synthetic oligonucleotide
gagggactcgcgcgagtccctc

SEQ ID NO: 10583 - DNA, 22 bp, Artificial Sequence
  Description of Artificial Sequence: Synthetic oligonucleotide
gtgggactcgcgcgagtcccac

SEQ ID NO: 10584 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcacgtgagtcnnnn

SEQ ID NO: 10585 - DNA, 22 bp, Artificial Sequence
  Description of Artificial Sequence: Synthetic oligonucleotide
ggcggactcacgtgagtccgcc

SEQ ID NO: 10586 - DNA, 22 bp, Artificial Sequence
  Description of Artificial Sequence: Synthetic oligonucleotide
agcggactcacgtgagtccgct

SEQ ID NO: 10587 - DNA, 22 bp, Artificial Sequence
  Description of Artificial Sequence: Synthetic oligonucleotide
gacggactcacgtgagtccgtc

SEQ ID NO: 10588 - DNA, 22 bp, Artificial Sequence
  Description of Artificial Sequence: Synthetic oligonucleotide
ggaggactcacgtgagtcctcc

SEQ ID NO: 10589 - DNA, 22 bp, Artificial Sequence
  Description of Artificial Sequence: Synthetic oligonucleotide
ggcagactcacgtgagtctgcc

SEQ ID NO: 10590 - DNA, 22 bp, Artificial Sequence
  Description of Artificial Sequence: Synthetic oligonucleotide
tgcggactcacgtgagtccgca

SEQ ID NO: 10591 - DNA, 22 bp, Artificial Sequence
  Description of Artificial Sequence: Synthetic oligonucleotide
gtcggactcacgtgagtccgac

SEQ ID NO: 10592 - DNA, 22 bp, Artificial Sequence
  Description of Artificial Sequence: Synthetic oligonucleotide
ggtggactcacgtgagtccacc

SEQ ID NO: 10593 - DNA, 22 bp, Artificial Sequence
  Description of Artificial Sequence: Synthetic oligonucleotide
ggctgactcacgtgagtcagcc

SEQ ID NO: 10594 - DNA, 22 bp, Artificial Sequence
  Description of Artificial Sequence: Synthetic oligonucleotide
gcccgactcacgtgagtcgggc

SEQ ID NO: 10595 - DNA, 22 bp, Artificial Sequence
  Description of Artificial Sequence: Synthetic oligonucleotide
acccgactcacgtgagtcgggt

SEQ ID NO: 10596 - DNA, 22 bp, Artificial Sequence
  Description of Artificial Sequence: Synthetic oligonucleotide
gaccgactcacgtgagtcggtc

SEQ ID NO: 10597 - DNA, 22 bp, Artificial Sequence
  Description of Artificial Sequence: Synthetic oligonucleotide
gcacgactcacgtgagtcgtgc

SEQ ID NO: 10598 - DNA, 22 bp, Artificial Sequence
  Description of Artificial Sequence: Synthetic oligonucleotide
gccagactcacgtgagtctggc

SEQ ID NO: 10599 - DNA, 22 bp, Artificial Sequence
  Description of Artificial Sequence: Synthetic oligonucleotide
tcccgactcacgtgagtcggga

SEQ ID NO: 10600 - DNA, 22 bp, Artificial Sequence
  Description of Artificial Sequence: Synthetic oligonucleotide
gtccgactcacgtgagtcggac

SEQ ID NO: 10601 - DNA, 22 bp, Artificial Sequence
  Description of Artificial Sequence: Synthetic oligonucleotide
gcctgactcacgtgagtcaggc

SEQ ID NO: 10602 - DNA, 22 bp, Artificial Sequence
  Description of Artificial Sequence: Synthetic oligonucleotide
gggcgactcacgtgagtcgccc

SEQ ID NO: 10603 - DNA, 22 bp, Artificial Sequence
  Description of Artificial Sequence: Synthetic oligonucleotide
aggcgactcacgtgagtcgcct

SEQ ID NO: 10604 - DNA, 22 bp, Artificial Sequence
  Description of Artificial Sequence: Synthetic oligonucleotide
gagcgactcacgtgagtcgctc

SEQ ID NO: 10605 - DNA, 22 bp, Artificial Sequence
  Description of Artificial Sequence: Synthetic oligonucleotide
ggacgactcacgtgagtcgtcc

SEQ ID NO: 10606 - DNA, 22 bp, Artificial Sequence
  Description of Artificial Sequence: Synthetic oligonucleotide
gggagactcacgtgagtctccc

SEQ ID NO: 10607 - DNA, 22 bp, Artificial Sequence
  Description of Artificial Sequence: Synthetic oligonucleotide
tggcgactcacgtgagtcgcca

SEQ ID NO: 10608 - DNA, 22 bp, Artificial Sequence
  Description of Artificial Sequence: Synthetic oligonucleotide
gtgcgactcacgtgagtcgcac

SEQ ID NO: 10609 - DNA, 22 bp, Artificial Sequence
  Description of Artificial Sequence: Synthetic oligonucleotide
gggtgactcacgtgagtcaccc

SEQ ID NO: 10610 - DNA, 22 bp, Artificial Sequence
  Description of Artificial Sequence: Synthetic oligonucleotide
acgggactcacgtgagtcccgt

SEQ ID NO: 10611 - DNA, 22 bp, Artificial Sequence
  Description of Artificial Sequence: Synthetic oligonucleotide
cagggactcacgtgagtccctg

SEQ ID NO: 10612 - DNA, 22 bp, Artificial Sequence
  Description of Artificial Sequence: Synthetic oligonucleotide
ccaggactcacgtgagtcctgg

SEQ ID NO: 10613 - DNA, 22 bp, Artificial Sequence
  Description of Artificial Sequence: Synthetic oligonucleotide
ccgagactcacgtgagtctcgg

SEQ ID NO: 10614 - DNA, 22 bp, Artificial Sequence
  Description of Artificial Sequence: Synthetic oligonucleotide
tcgggactcacgtgagtcccga

SEQ ID NO: 10615 - DNA, 22 bp, Artificial Sequence
  Description of Artificial Sequence: Synthetic oligonucleotide
ctgggactcacgtgagtcccag

SEQ ID NO: 10616 - DNA, 22 bp, Artificial Sequence
  Description of Artificial Sequence: Synthetic oligonucleotide
cctggactcacgtgagtccagg

SEQ ID NO: 10617 - DNA, 22 bp, Artificial Sequence
  Description of Artificial Sequence: Synthetic oligonucleotide
ccgtgactcacgtgagtcacgg

SEQ ID NO: 10618 - DNA, 22 bp, Artificial Sequence
  Description of Artificial Sequence: Synthetic oligonucleotide
cggcgactcacgtgagtcgccg

SEQ ID NO: 10619 - DNA, 22 bp, Artificial Sequence
  Description of Artificial Sequence: Synthetic oligonucleotide
cagcgactcacgtgagtcgctg

SEQ ID NO: 10620 - DNA, 22 bp, Artificial Sequence
  Description of Artificial Sequence: Synthetic oligonucleotide
cgacgactcacgtgagtcgtcg

SEQ ID NO: 10621 - DNA, 22 bp, Artificial Sequence
  Description of Artificial Sequence: Synthetic oligonucleotide
cggagactcacgtgagtctccg

SEQ ID NO: 10622 - DNA, 22 bp, Artificial Sequence
  Description of Artificial Sequence: Synthetic oligonucleotide
ctgcgactcacgtgagtcgcag

SEQ ID NO: 10623 - DNA, 22 bp, Artificial Sequence
  Description of Artificial Sequence: Synthetic oligonucleotide
cggtgactcacgtgagtcaccg

SEQ ID NO: 10624 - DNA, 22 bp, Artificial Sequence
  Description of Artificial Sequence: Synthetic oligonucleotide
cacggactcacgtgagtccgtg

SEQ ID NO: 10625 - DNA, 22 bp, Artificial Sequence
  Description of Artificial Sequence: Synthetic oligonucleotide
cccagactcacgtgagtctggg

SEQ ID NO: 10626 - DNA, 22 bp, Artificial Sequence
  Description of Artificial Sequence: Synthetic oligonucleotide
ctcggactcacgtgagtccgag

SEQ ID NO: 10627 - DNA, 22 bp, Artificial Sequence
  Description of Artificial Sequence: Synthetic oligonucleotide
ccctgactcacgtgagtcaggg

SEQ ID NO: 10628 - DNA, 22 bp, Artificial Sequence
  Description of Artificial Sequence: Synthetic oligonucleotide
ccacgactcacgtgagtcgtgg

SEQ ID NO: 10629 - DNA, 22 bp, Artificial Sequence
  Description of Artificial Sequence: Synthetic oligonucleotide
agccgactcacgtgagtcggct

SEQ ID NO: 10630 - DNA, 22 bp, Artificial Sequence
  Description of Artificial Sequence: Synthetic oligonucleotide
tgccgactcacgtgagtcggca

SEQ ID NO: 10631 - DNA, 22 bp, Artificial Sequence
  Description of Artificial Sequence: Synthetic oligonucleotide
gcgagactcacgtgagtctcgc

SEQ ID NO: 10632 - DNA, 22 bp, Artificial Sequence
  Description of Artificial Sequence: Synthetic oligonucleotide
gcgtgactcacgtgagtcacgc

SEQ ID NO: 10633 - DNA, 22 bp, Artificial Sequence
  Description of Artificial Sequence: Synthetic oligonucleotide
gcaggactcacgtgagtcctgc

SEQ ID NO: 10634 - DNA, 22 bp, Artificial Sequence
  Description of Artificial Sequence: Synthetic oligonucleotide
gctggactcacgtgagtccagc

SEQ ID NO: 10635 - DNA, 22 bp, Artificial Sequence
  Description of Artificial Sequence: Synthetic oligonucleotide
cgaggactcacgtgagtcctcg

SEQ ID NO: 10636 - DNA, 22 bp, Artificial Sequence
  Description of Artificial Sequence: Synthetic oligonucleotide
cgtggactcacgtgagtccacg

SEQ ID NO: 10637 - DNA, 22 bp, Artificial Sequence
  Description of Artificial Sequence: Synthetic oligonucleotide
caccgactcacgtgagtcggtg

SEQ ID NO: 10638 - DNA, 22 bp, Artificial Sequence
  Description of Artificial Sequence: Synthetic oligonucleotide
ctccgactcacgtgagtcggag

SEQ ID NO: 10639 - DNA, 22 bp, Artificial Sequence
  Description of Artificial Sequence: Synthetic oligonucleotide
gcgggactcacgtgagtcccgc

SEQ ID NO: 10640 - DNA, 22 bp, Artificial Sequence
  Description of Artificial Sequence: Synthetic oligonucleotide
gagggactcacgtgagtccctc

SEQ ID NO: 10641 - DNA, 22 bp, Artificial Sequence
  Description of Artificial Sequence: Synthetic oligonucleotide
gtgggactcacgtgagtcccac

SEQ ID NO: 10642 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcggccgagtcnnnn

SEQ ID NO: 10643 - DNA, 22 bp, Artificial Sequence
  Description of Artificial Sequence: Synthetic oligonucleotide
ggcggactcggccgagtccgcc

SEQ ID NO: 10644 - DNA, 22 bp, Artificial Sequence
  Description of Artificial Sequence: Synthetic oligonucleotide
agcggactcggccgagtccgct

SEQ ID NO: 10645 - DNA, 22 bp, Artificial Sequence
  Description of Artificial Sequence: Synthetic oligonucleotide
gacggactcggccgagtccgtc

SEQ ID NO: 10646 - DNA, 22 bp, Artificial Sequence
  Description of Artificial Sequence: Synthetic oligonucleotide
ggaggactcggccgagtcctcc

SEQ ID NO: 10647 - DNA, 22 bp, Artificial Sequence
  Description of Artificial Sequence: Synthetic oligonucleotide
ggcagactcggccgagtctgcc

SEQ ID NO: 10648 - DNA, 22 bp, Artificial Sequence
  Description of Artificial Sequence: Synthetic oligonucleotide
tgcggactcggccgagtccgca

SEQ ID NO: 10649 - DNA, 22 bp, Artificial Sequence
  Description of Artificial Sequence: Synthetic oligonucleotide
gtcggactcggccgagtccgac

SEQ ID NO: 10650 - DNA, 22 bp, Artificial Sequence
  Description of Artificial Sequence: Synthetic oligonucleotide
ggtggactcggccgagtccacc

SEQ ID NO: 10651 - DNA, 22 bp, Artificial Sequence
  Description of Artificial Sequence: Synthetic oligonucleotide
ggctgactcggccgagtcagcc

SEQ ID NO: 10652 - DNA, 22 bp, Artificial Sequence
  Description of Artificial Sequence: Synthetic oligonucleotide
gcccgactcggccgagtcgggc

SEQ ID NO: 10653 - DNA, 22 bp, Artificial Sequence
  Description of Artificial Sequence: Synthetic oligonucleotide
acccgactcggccgagtcgggt

SEQ ID NO: 10654 - DNA, 22 bp, Artificial Sequence
  Description of Artificial Sequence: Synthetic oligonucleotide
gaccgactcggccgagtcggtc

SEQ ID NO: 10655 - DNA, 22 bp, Artificial Sequence
  Description of Artificial Sequence: Synthetic oligonucleotide
gcacgactcggccgagtcgtgc

SEQ ID NO: 10656 - DNA, 22 bp, Artificial Sequence
  Description of Artificial Sequence: Synthetic oligonucleotide
gccagactcggccgagtctggc

SEQ ID NO: 10657 - DNA, 22 bp, Artificial Sequence
  Description of Artificial Sequence: Synthetic oligonucleotide
tcccgactcggccgagtcggga

SEQ ID NO: 10658 - DNA, 22 bp, Artificial Sequence
  Description of Artificial Sequence: Synthetic oligonucleotide
gtccgactcggccgagtcggac

SEQ ID NO: 10659 - DNA, 22 bp, Artificial Sequence
  Description of Artificial Sequence: Synthetic oligonucleotide
gcctgactcggccgagtcaggc

SEQ ID NO: 10660 - DNA, 22 bp, Artificial Sequence
  Description of Artificial Sequence: Synthetic oligonucleotide
gggcgactcggccgagtcgccc

SEQ ID NO: 10661 - DNA, 22 bp, Artificial Sequence
  Description of Artificial Sequence: Synthetic oligonucleotide
aggcgactcggccgagtcgcct

SEQ ID NO: 10662 - DNA, 22 bp, Artificial Sequence
  Description of Artificial Sequence: Synthetic oligonucleotide
gagcgactcggccgagtcgctc

SEQ ID NO: 10663 - DNA, 22 bp, Artificial Sequence
  Description of Artificial Sequence: Synthetic oligonucleotide
ggacgactcggccgagtcgtcc

SEQ ID NO: 10664 - DNA, 22 bp, Artificial Sequence
  Description of Artificial Sequence: Synthetic oligonucleotide
gggagactcggccgagtctccc

SEQ ID NO: 10665 - DNA, 22 bp, Artificial Sequence
  Description of Artificial Sequence: Synthetic oligonucleotide
tggcgactcggccgagtcgcca

SEQ ID NO: 10666 - DNA, 22 bp, Artificial Sequence
  Description of Artificial Sequence: Synthetic oligonucleotide
gtgcgactcggccgagtcgcac

SEQ ID NO: 10667 - DNA, 22 bp, Artificial Sequence
  Description of Artificial Sequence: Synthetic oligonucleotide
gggtgactcggccgagtcaccc

SEQ ID NO: 10668 - DNA, 22 bp, Artificial Sequence
  Description of Artificial Sequence: Synthetic oligonucleotide
acgggactcggccgagtcccgt

SEQ ID NO: 10669 - DNA, 22 bp, Artificial Sequence
  Description of Artificial Sequence: Synthetic oligonucleotide
cagggactcggccgagtccctg

SEQ ID NO: 10670 - DNA, 22 bp, Artificial Sequence
  Description of Artificial Sequence: Synthetic oligonucleotide
ccaggactcggccgagtcctgg

SEQ ID NO: 10671 - DNA, 22 bp, Artificial Sequence
  Description of Artificial Sequence: Synthetic oligonucleotide
ccgagactcggccgagtctcgg

SEQ ID NO: 10672 - DNA, 22 bp, Artificial Sequence
  Description of Artificial Sequence: Synthetic oligonucleotide
tcgggactcggccgagtcccga

SEQ ID NO: 10673 - DNA, 22 bp, Artificial Sequence
  Description of Artificial Sequence: Synthetic oligonucleotide
ctgggactcggccgagtcccag

SEQ ID NO: 10674 - DNA, 22 bp, Artificial Sequence
  Description of Artificial Sequence: Synthetic oligonucleotide
cctggactcggccgagtccagg

SEQ ID NO: 10675 - DNA, 22 bp, Artificial Sequence
  Description of Artificial Sequence: Synthetic oligonucleotide
ccgtgactcggccgagtcacgg

SEQ ID NO: 10676 - DNA, 22 bp, Artificial Sequence
  Description of Artificial Sequence: Synthetic oligonucleotide
cggcgactcggccgagtcgccg

SEQ ID NO: 10677 - DNA, 22 bp, Artificial Sequence
  Description of Artificial Sequence: Synthetic oligonucleotide
cagcgactcggccgagtcgctg

SEQ ID NO: 10678 - DNA, 22 bp, Artificial Sequence
  Description of Artificial Sequence: Synthetic oligonucleotide
cgacgactcggccgagtcgtcg

SEQ ID NO: 10679 - DNA, 22 bp, Artificial Sequence
  Description of Artificial Sequence: Synthetic oligonucleotide
cggagactcggccgagtctccg

SEQ ID NO: 10680 - DNA, 22 bp, Artificial Sequence
  Description of Artificial Sequence: Synthetic oligonucleotide
ctgcgactcggccgagtcgcag

SEQ ID NO: 10681 - DNA, 22 bp, Artificial Sequence
  Description of Artificial Sequence: Synthetic oligonucleotide
cggtgactcggccgagtcaccg

SEQ ID NO: 10682 - DNA, 22 bp, Artificial Sequence
  Description of Artificial Sequence: Synthetic oligonucleotide
cacggactcggccgagtccgtg

SEQ ID NO: 10683 - DNA, 22 bp, Artificial Sequence
  Description of Artificial Sequence: Synthetic oligonucleotide
cccagactcggccgagtctggg

SEQ ID NO: 10684 - DNA, 22 bp, Artificial Sequence
  Description of Artificial Sequence: Synthetic oligonucleotide
ctcggactcggccgagtccgag

SEQ ID NO: 10685 - DNA, 22 bp, Artificial Sequence
  Description of Artificial Sequence: Synthetic oligonucleotide
ccctgactcggccgagtcaggg

SEQ ID NO: 10686 - DNA, 22 bp, Artificial Sequence
  Description of Artificial Sequence: Synthetic oligonucleotide
ccacgactcggccgagtcgtgg

SEQ ID NO: 10687 - DNA, 22 bp, Artificial Sequence
  Description of Artificial Sequence: Synthetic oligonucleotide
agccgactcggccgagtcggct

SEQ ID NO: 10688 - DNA, 22 bp, Artificial Sequence
  Description of Artificial Sequence: Synthetic oligonucleotide
tgccgactcggccgagtcggca

SEQ ID NO: 10689 - DNA, 22 bp, Artificial Sequence
  Description of Artificial Sequence: Synthetic oligonucleotide
gcgagactcggccgagtctcgc

SEQ ID NO: 10690 - DNA, 22 bp, Artificial Sequence
  Description of Artificial Sequence: Synthetic oligonucleotide
gcgtgactcggccgagtcacgc

SEQ ID NO: 10691 - DNA, 22 bp, Artificial Sequence
  Description of Artificial Sequence: Synthetic oligonucleotide
gcaggactcggccgagtcctgc

SEQ ID NO: 10692 - DNA, 22 bp, Artificial Sequence
  Description of Artificial Sequence: Synthetic oligonucleotide
gctggactcggccgagtccagc

SEQ ID NO: 10693 - DNA, 22 bp, Artificial Sequence
  Description of Artificial Sequence: Synthetic oligonucleotide
cgaggactcggccgagtcctcg

SEQ ID NO: 10694 - DNA, 22 bp, Artificial Sequence
  Description of Artificial Sequence: Synthetic oligonucleotide
cgtggactcggccgagtccacg

SEQ ID NO: 10695 - DNA, 22 bp, Artificial Sequence
  Description of Artificial Sequence: Synthetic oligonucleotide
caccgactcggccgagtcggtg

SEQ ID NO: 10696 - DNA, 22 bp, Artificial Sequence
  Description of Artificial Sequence: Synthetic oligonucleotide
ctccgactcggccgagtcggag

SEQ ID NO: 10697 - DNA, 22 bp, Artificial Sequence
  Description of Artificial Sequence: Synthetic oligonucleotide
gcgggactcggccgagtcccgc

SEQ ID NO: 10698 - DNA, 22 bp, Artificial Sequence
  Description of Artificial Sequence: Synthetic oligonucleotide
gagggactcggccgagtccctc

SEQ ID NO: 10699 - DNA, 22 bp, Artificial Sequence
  Description of Artificial Sequence: Synthetic oligonucleotide
gtgggactcggccgagtcccac

SEQ ID NO: 10700 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcccgggagtcnnnn

SEQ ID NO: 10701 - DNA, 22 bp, Artificial Sequence
  Description of Artificial Sequence: Synthetic oligonucleotide
ggcggactcccgggagtccgcc

SEQ ID NO: 10702 - DNA, 22 bp, Artificial Sequence
  Description of Artificial Sequence: Synthetic oligonucleotide
agcggactcccgggagtccgct

SEQ ID NO: 10703 - DNA, 22 bp, Artificial Sequence
  Description of Artificial Sequence: Synthetic oligonucleotide
gacggactcccgggagtccgtc

SEQ ID NO: 10704 - DNA, 22 bp, Artificial Sequence
  Description of Artificial Sequence: Synthetic oligonucleotide
ggaggactcccgggagtcctcc

SEQ ID NO: 10705 - DNA, 22 bp, Artificial Sequence
  Description of Artificial Sequence: Synthetic oligonucleotide
ggcagactcccgggagtctgcc

SEQ ID NO: 10706 - DNA, 22 bp, Artificial Sequence
  Description of Artificial Sequence: Synthetic oligonucleotide
tgcggactcccgggagtccgca

SEQ ID NO: 10707 - DNA, 22 bp, Artificial Sequence
  Description of Artificial Sequence: Synthetic oligonucleotide
gtcggactcccgggagtccgac

SEQ ID NO: 10708 - DNA, 22 bp, Artificial Sequence
  Description of Artificial Sequence: Synthetic oligonucleotide
ggtggactcccgggagtccacc

SEQ ID NO: 10709 - DNA, 22 bp, Artificial Sequence
  Description of Artificial Sequence: Synthetic oligonucleotide
ggctgactcccgggagtcagcc

SEQ ID NO: 10710 - DNA, 22 bp, Artificial Sequence
  Description of Artificial Sequence: Synthetic oligonucleotide
gcccgactcccgggagtcgggc

SEQ ID NO: 10711 - DNA, 22 bp, Artificial Sequence
  Description of Artificial Sequence: Synthetic oligonucleotide
acccgactcccgggagtcgggt

SEQ ID NO: 10712 - DNA, 22 bp, Artificial Sequence
  Description of Artificial Sequence: Synthetic oligonucleotide
gaccgactcccgggagtcggtc

SEQ ID NO: 10713 - DNA, 22 bp, Artificial Sequence
  Description of Artificial Sequence: Synthetic oligonucleotide
gcacgactcccgggagtcgtgc

SEQ ID NO: 10714 - DNA, 22 bp, Artificial Sequence
  Description of Artificial Sequence: Synthetic oligonucleotide
gccagactcccgggagtctggc

SEQ ID NO: 10715 - DNA, 22 bp, Artificial Sequence
  Description of Artificial Sequence: Synthetic oligonucleotide
tcccgactcccgggagtcggga

SEQ ID NO: 10716 - DNA, 22 bp, Artificial Sequence
  Description of Artificial Sequence: Synthetic oligonucleotide
gtccgactcccgggagtcggac

SEQ ID NO: 10717 - DNA, 22 bp, Artificial Sequence
  Description of Artificial Sequence: Synthetic oligonucleotide
gcctgactcccgggagtcaggc

SEQ ID NO: 10718 - DNA, 22 bp, Artificial Sequence
  Description of Artificial Sequence: Synthetic oligonucleotide
gggcgactcccgggagtcgccc

SEQ ID NO: 10719 - DNA, 22 bp, Artificial Sequence
  Description of Artificial Sequence: Synthetic oligonucleotide
aggcgactcccgggagtcgcct

SEQ ID NO: 10720 - DNA, 22 bp, Artificial Sequence
  Description of Artificial Sequence: Synthetic oligonucleotide
gagcgactcccgggagtcgctc

SEQ ID NO: 10721 - DNA, 22 bp, Artificial Sequence
  Description of Artificial Sequence: Synthetic oligonucleotide
ggacgactcccgggagtcgtcc

SEQ ID NO: 10722 - DNA, 22 bp, Artificial Sequence
  Description of Artificial Sequence: Synthetic oligonucleotide
gggagactcccgggagtctccc

SEQ ID NO: 10723 - DNA, 22 bp, Artificial Sequence
  Description of Artificial Sequence: Synthetic oligonucleotide
tggcgactcccgggagtcgcca

SEQ ID NO: 10724 - DNA, 22 bp, Artificial Sequence
  Description of Artificial Sequence: Synthetic oligonucleotide
gtgcgactcccgggagtcgcac

SEQ ID NO: 10725 - DNA, 22 bp, Artificial Sequence
  Description of Artificial Sequence: Synthetic oligonucleotide
gggtgactcccgggagtcaccc

SEQ ID NO: 10726 - DNA, 22 bp, Artificial Sequence
  Description of Artificial Sequence: Synthetic oligonucleotide
acgggactcccgggagtcccgt

SEQ ID NO: 10727 - DNA, 22 bp, Artificial Sequence
  Description of Artificial Sequence: Synthetic oligonucleotide
cagggactcccgggagtccctg

SEQ ID NO: 10728 - DNA, 22 bp, Artificial Sequence
  Description of Artificial Sequence: Synthetic oligonucleotide
ccaggactcccgggagtcctgg

SEQ ID NO: 10729 - DNA, 22 bp, Artificial Sequence
  Description of Artificial Sequence: Synthetic oligonucleotide
ccgagactcccgggagtctcgg

SEQ ID NO: 10730 - DNA, 22 bp, Artificial Sequence
  Description of Artificial Sequence: Synthetic oligonucleotide
tcgggactcccgggagtcccga

SEQ ID NO: 10731 - DNA, 22 bp, Artificial Sequence
  Description of Artificial Sequence: Synthetic oligonucleotide
ctgggactcccgggagtcccag

SEQ ID NO: 10732 - DNA, 22 bp, Artificial Sequence
  Description of Artificial Sequence: Synthetic oligonucleotide
cctggactcccgggagtccagg

SEQ ID NO: 10733 - DNA, 22 bp, Artificial Sequence
  Description of Artificial Sequence: Synthetic oligonucleotide
ccgtgactcccgggagtcacgg

SEQ ID NO: 10734 - DNA, 22 bp, Artificial Sequence
  Description of Artificial Sequence: Synthetic oligonucleotide
cggcgactcccgggagtcgccg

SEQ ID NO: 10735 - DNA, 22 bp, Artificial Sequence
  Description of Artificial Sequence: Synthetic oligonucleotide
cagcgactcccgggagtcgctg

SEQ ID NO: 10736 - DNA, 22 bp, Artificial Sequence
  Description of Artificial Sequence: Synthetic oligonucleotide
cgacgactcccgggagtcgtcg

SEQ ID NO: 10737 - DNA, 22 bp, Artificial Sequence
  Description of Artificial Sequence: Synthetic oligonucleotide
cggagactcccgggagtctccg

SEQ ID NO: 10738 - DNA, 22 bp, Artificial Sequence
  Description of Artificial Sequence: Synthetic oligonucleotide
ctgcgactcccgggagtcgcag

SEQ ID NO: 10739 - DNA, 22 bp, Artificial Sequence
  Description of Artificial Sequence: Synthetic oligonucleotide
cggtgactcccgggagtcaccg

SEQ ID NO: 10740 - DNA, 22 bp, Artificial Sequence
  Description of Artificial Sequence: Synthetic oligonucleotide
cacggactcccgggagtccgtg

SEQ ID NO: 10741 - DNA, 22 bp, Artificial Sequence
  Description of Artificial Sequence: Synthetic oligonucleotide
cccagactcccgggagtctggg

SEQ ID NO: 10742 - DNA, 22 bp, Artificial Sequence
  Description of Artificial Sequence: Synthetic oligonucleotide
ctcggactcccgggagtccgag

SEQ ID NO: 10743 - DNA, 22 bp, Artificial Sequence
  Description of Artificial Sequence: Synthetic oligonucleotide
ccctgactcccgggagtcaggg

SEQ ID NO: 10744 - DNA, 22 bp, Artificial Sequence
  Description of Artificial Sequence: Synthetic oligonucleotide
ccacgactcccgggagtcgtgg

SEQ ID NO: 10745 - DNA, 22 bp, Artificial Sequence
  Description of Artificial Sequence: Synthetic oligonucleotide
agccgactcccgggagtcggct

SEQ ID NO: 10746 - DNA, 22 bp, Artificial Sequence
  Description of Artificial Sequence: Synthetic oligonucleotide
tgccgactcccgggagtcggca

SEQ ID NO: 10747 - DNA, 22 bp, Artificial Sequence
  Description of Artificial Sequence: Synthetic oligonucleotide
gcgagactcccgggagtctcgc

SEQ ID NO: 10748 - DNA, 22 bp, Artificial Sequence
  Description of Artificial Sequence: Synthetic oligonucleotide
gcgtgactcccgggagtcacgc

SEQ ID NO: 10749 - DNA, 22 bp, Artificial Sequence
  Description of Artificial Sequence: Synthetic oligonucleotide
gcaggactcccgggagtcctgc

SEQ ID NO: 10750 - DNA, 22 bp, Artificial Sequence
  Description of Artificial Sequence: Synthetic oligonucleotide
gctggactcccgggagtccagc

SEQ ID NO: 10751 - DNA, 22 bp, Artificial Sequence
  Description of Artificial Sequence: Synthetic oligonucleotide
cgaggactcccgggagtcctcg

SEQ ID NO: 10752 - DNA, 22 bp, Artificial Sequence
  Description of Artificial Sequence: Synthetic oligonucleotide
cgtggactcccgggagtccacg

SEQ ID NO: 10753 - DNA, 22 bp, Artificial Sequence
  Description of Artificial Sequence: Synthetic oligonucleotide
caccgactcccgggagtcggtg

SEQ ID NO: 10754 - DNA, 22 bp, Artificial Sequence
  Description of Artificial Sequence: Synthetic oligonucleotide
ctccgactcccgggagtcggag

SEQ ID NO: 10755 - DNA, 22 bp, Artificial Sequence
  Description of Artificial Sequence: Synthetic oligonucleotide
gcgggactcccgggagtcccgc

SEQ ID NO: 10756 - DNA, 22 bp, Artificial Sequence
  Description of Artificial Sequence: Synthetic oligonucleotide
gagggactcccgggagtccctc

SEQ ID NO: 10757 - DNA, 22 bp, Artificial Sequence
  Description of Artificial Sequence: Synthetic oligonucleotide
gtgggactcccgggagtcccac

SEQ ID NO: 10758 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcgtacgagtcnnnn

SEQ ID NO: 10759 - DNA, 22 bp, Artificial Sequence
  Description of Artificial Sequence: Synthetic oligonucleotide
ggcggactcgtacgagtccgcc

SEQ ID NO: 10760 - DNA, 22 bp, Artificial Sequence
  Description of Artificial Sequence: Synthetic oligonucleotide
agcggactcgtacgagtccgct

SEQ ID NO: 10761 - DNA, 22 bp, Artificial Sequence
  Description of Artificial Sequence: Synthetic oligonucleotide
gacggactcgtacgagtccgtc

SEQ ID NO: 10762 - DNA, 22 bp, Artificial Sequence
  Description of Artificial Sequence: Synthetic oligonucleotide
ggaggactcgtacgagtcctcc

SEQ ID NO: 10763 - DNA, 22 bp, Artificial Sequence
  Description of Artificial Sequence: Synthetic oligonucleotide
ggcagactcgtacgagtctgcc

SEQ ID NO: 10764 - DNA, 22 bp, Artificial Sequence
  Description of Artificial Sequence: Synthetic oligonucleotide
tgcggactcgtacgagtccgca

SEQ ID NO: 10765 - DNA, 22 bp, Artificial Sequence
  Description of Artificial Sequence: Synthetic oligonucleotide
gtcggactcgtacgagtccgac

SEQ ID NO: 10766 - DNA, 22 bp, Artificial Sequence
  Description of Artificial Sequence: Synthetic oligonucleotide
ggtggactcgtacgagtccacc

SEQ ID NO: 10767 - DNA, 22 bp, Artificial Sequence
  Description of Artificial Sequence: Synthetic oligonucleotide
ggctgactcgtacgagtcagcc

SEQ ID NO: 10768 - DNA, 22 bp, Artificial Sequence
  Description of Artificial Sequence: Synthetic oligonucleotide
gcccgactcgtacgagtcgggc

SEQ ID NO: 10769 - DNA, 22 bp, Artificial Sequence
  Description of Artificial Sequence: Synthetic oligonucleotide
acccgactcgtacgagtcgggt

SEQ ID NO: 10770 - DNA, 22 bp, Artificial Sequence
  Description of Artificial Sequence: Synthetic oligonucleotide
gaccgactcgtacgagtcggtc

SEQ ID NO: 10771 - DNA, 22 bp, Artificial Sequence
  Description of Artificial Sequence: Synthetic oligonucleotide
gcacgactcgtacgagtcgtgc

SEQ ID NO: 10772 - DNA, 22 bp, Artificial Sequence
  Description of Artificial Sequence: Synthetic oligonucleotide
gccagactcgtacgagtctggc

SEQ ID NO: 10773 - DNA, 22 bp, Artificial Sequence
  Description of Artificial Sequence: Synthetic oligonucleotide
tcccgactcgtacgagtcggga

SEQ ID NO: 10774 - DNA, 22 bp, Artificial Sequence
  Description of Artificial Sequence: Synthetic oligonucleotide
gtccgactcgtacgagtcggac

SEQ ID NO: 10775 - DNA, 22 bp, Artificial Sequence
  Description of Artificial Sequence: Synthetic oligonucleotide
gcctgactcgtacgagtcaggc

SEQ ID NO: 10776 - DNA, 22 bp, Artificial Sequence
  Description of Artificial Sequence: Synthetic oligonucleotide
gggcgactcgtacgagtcgccc

SEQ ID NO: 10777 - DNA, 22 bp, Artificial Sequence
  Description of Artificial Sequence: Synthetic oligonucleotide
aggcgactcgtacgagtcgcct

SEQ ID NO: 10778 - DNA, 22 bp, Artificial Sequence
  Description of Artificial Sequence: Synthetic oligonucleotide
gagcgactcgtacgagtcgctc

SEQ ID NO: 10779 - DNA, 22 bp, Artificial Sequence
  Description of Artificial Sequence: Synthetic oligonucleotide
ggacgactcgtacgagtcgtcc

SEQ ID NO: 10780 - DNA, 22 bp, Artificial Sequence
  Description of Artificial Sequence: Synthetic oligonucleotide
gggagactcgtacgagtctccc

SEQ ID NO: 10781 - DNA, 22 bp, Artificial Sequence
  Description of Artificial Sequence: Synthetic oligonucleotide
tggcgactcgtacgagtcgcca

SEQ ID NO: 10782 - DNA, 22 bp, Artificial Sequence
  Description of Artificial Sequence: Synthetic oligonucleotide
gtgcgactcgtacgagtcgcac

SEQ ID NO: 10783 - DNA, 22 bp, Artificial Sequence
  Description of Artificial Sequence: Synthetic oligonucleotide
gggtgactcgtacgagtcaccc

SEQ ID NO: 10784 - DNA, 22 bp, Artificial Sequence
  Description of Artificial Sequence: Synthetic oligonucleotide
acgggactcgtacgagtcccgt

SEQ ID NO: 10785 - DNA, 22 bp, Artificial Sequence
  Description of Artificial Sequence: Synthetic oligonucleotide
cagggactcgtacgagtccctg

SEQ ID NO: 10786 - DNA, 22 bp, Artificial Sequence
  Description of Artificial Sequence: Synthetic oligonucleotide
ccaggactcgtacgagtcctgg

SEQ ID NO: 10787 - DNA, 22 bp, Artificial Sequence
  Description of Artificial Sequence: Synthetic oligonucleotide
ccgagactcgtacgagtctcgg

SEQ ID NO: 10788 - DNA, 22 bp, Artificial Sequence
  Description of Artificial Sequence: Synthetic oligonucleotide
tcgggactcgtacgagtcccga

SEQ ID NO: 10789 - DNA, 22 bp, Artificial Sequence
  Description of Artificial Sequence: Synthetic oligonucleotide
ctgggactcgtacgagtcccag

SEQ ID NO: 10790 - DNA, 22 bp, Artificial Sequence
  Description of Artificial Sequence: Synthetic oligonucleotide
cctggactcgtacgagtccagg

SEQ ID NO: 10791 - DNA, 22 bp, Artificial Sequence
  Description of Artificial Sequence: Synthetic oligonucleotide
ccgtgactcgtacgagtcacgg

SEQ ID NO: 10792 - DNA, 22 bp, Artificial Sequence
  Description of Artificial Sequence: Synthetic oligonucleotide
cggcgactcgtacgagtcgccg

SEQ ID NO: 10793 - DNA, 22 bp, Artificial Sequence
  Description of Artificial Sequence: Synthetic oligonucleotide
cagcgactcgtacgagtcgctg

SEQ ID NO: 10794 - DNA, 22 bp, Artificial Sequence
  Description of Artificial Sequence: Synthetic oligonucleotide
cgacgactcgtacgagtcgtcg

SEQ ID NO: 10795 - DNA, 22 bp, Artificial Sequence
  Description of Artificial Sequence: Synthetic oligonucleotide
cggagactcgtacgagtctccg

SEQ ID NO: 10796 - DNA, 22 bp, Artificial Sequence
  Description of Artificial Sequence: Synthetic oligonucleotide
ctgcgactcgtacgagtcgcag

SEQ ID NO: 10797 - DNA, 22 bp, Artificial Sequence
  Description of Artificial Sequence: Synthetic oligonucleotide
cggtgactcgtacgagtcaccg

SEQ ID NO: 10798 - DNA, 22 bp, Artificial Sequence
  Description of Artificial Sequence: Synthetic oligonucleotide
cacggactcgtacgagtccgtg

SEQ ID NO: 10799 - DNA, 22 bp, Artificial Sequence
  Description of Artificial Sequence: Synthetic oligonucleotide
cccagactcgtacgagtctggg

SEQ ID NO: 10800 - DNA, 22 bp, Artificial Sequence
  Description of Artificial Sequence: Synthetic oligonucleotide
ctcggactcgtacgagtccgag

SEQ ID NO: 10801 - DNA, 22 bp, Artificial Sequence
  Description of Artificial Sequence: Synthetic oligonucleotide
ccctgactcgtacgagtcaggg

SEQ ID NO: 10802 - DNA, 22 bp, Artificial Sequence
  Description of Artificial Sequence: Synthetic oligonucleotide
ccacgactcgtacgagtcgtgg

SEQ ID NO: 10803 - DNA, 22 bp, Artificial Sequence
  Description of Artificial Sequence: Synthetic oligonucleotide
agccgactcgtacgagtcggct

SEQ ID NO: 10804 - DNA, 22 bp, Artificial Sequence
  Description of Artificial Sequence: Synthetic oligonucleotide
tgccgactcgtacgagtcggca

SEQ ID NO: 10805 - DNA, 22 bp, Artificial Sequence
  Description of Artificial Sequence: Synthetic oligonucleotide
gcgagactcgtacgagtctcgc

SEQ ID NO: 10806 - DNA, 22 bp, Artificial Sequence
  Description of Artificial Sequence: Synthetic oligonucleotide
gcgtgactcgtacgagtcacgc

SEQ ID NO: 10807 - DNA, 22 bp, Artificial Sequence
  Description of Artificial Sequence: Synthetic oligonucleotide
gcaggactcgtacgagtcctgc

SEQ ID NO: 10808 - DNA, 22 bp, Artificial Sequence
  Description of Artificial Sequence: Synthetic oligonucleotide
gctggactcgtacgagtccagc

SEQ ID NO: 10809 - DNA, 22 bp, Artificial Sequence
  Description of Artificial Sequence: Synthetic oligonucleotide
cgaggactcgtacgagtcctcg

SEQ ID NO: 10810 - DNA, 22 bp, Artificial Sequence
  Description of Artificial Sequence: Synthetic oligonucleotide
cgtggactcgtacgagtccacg

SEQ ID NO: 10811 - DNA, 22 bp, Artificial Sequence
  Description of Artificial Sequence: Synthetic oligonucleotide
caccgactcgtacgagtcggtg

SEQ ID NO: 10812 - DNA, 22 bp, Artificial Sequence
  Description of Artificial Sequence: Synthetic oligonucleotide
ctccgactcgtacgagtcggag

SEQ ID NO: 10813 - DNA, 22 bp, Artificial Sequence
  Description of Artificial Sequence: Synthetic oligonucleotide
gcgggactcgtacgagtcccgc

SEQ ID NO: 10814 - DNA, 22 bp, Artificial Sequence
  Description of Artificial Sequence: Synthetic oligonucleotide
gagggactcgtacgagtccctc

SEQ ID NO: 10815 - DNA, 22 bp, Artificial Sequence
  Description of Artificial Sequence: Synthetic oligonucleotide
gtgggactcgtacgagtcccac

SEQ ID NO: 10816 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcctaggagtcnnnn

SEQ ID NO: 10817 - DNA, 22 bp, Artificial Sequence
  Description of Artificial Sequence: Synthetic oligonucleotide
ggcggactcctaggagtccgcc

SEQ ID NO: 10818 - DNA, 22 bp, Artificial Sequence
  Description of Artificial Sequence: Synthetic oligonucleotide
agcggactcctaggagtccgct

SEQ ID NO: 10819 - DNA, 22 bp, Artificial Sequence
  Description of Artificial Sequence: Synthetic oligonucleotide
gacggactcctaggagtccgtc

SEQ ID NO: 10820 - DNA, 22 bp, Artificial Sequence
  Description of Artificial Sequence: Synthetic oligonucleotide
ggaggactcctaggagtcctcc

SEQ ID NO: 10821 - DNA, 22 bp, Artificial Sequence
  Description of Artificial Sequence: Synthetic oligonucleotide
ggcagactcctaggagtctgcc

SEQ ID NO: 10822 - DNA, 22 bp, Artificial Sequence
  Description of Artificial Sequence: Synthetic oligonucleotide
tgcggactcctaggagtccgca

SEQ ID NO: 10823 - DNA, 22 bp, Artificial Sequence
  Description of Artificial Sequence: Synthetic oligonucleotide
gtcggactcctaggagtccgac

SEQ ID NO: 10824 - DNA, 22 bp, Artificial Sequence
  Description of Artificial Sequence: Synthetic oligonucleotide
ggtggactcctaggagtccacc

SEQ ID NO: 10825 - DNA, 22 bp, Artificial Sequence
  Description of Artificial Sequence: Synthetic oligonucleotide
ggctgactcctaggagtcagcc

SEQ ID NO: 10826 - DNA, 22 bp, Artificial Sequence
  Description of Artificial Sequence: Synthetic oligonucleotide
gcccgactcctaggagtcgggc

SEQ ID NO: 10827 - DNA, 22 bp, Artificial Sequence
  Description of Artificial Sequence: Synthetic oligonucleotide
acccgactcctaggagtcgggt

SEQ ID NO: 10828 - DNA, 22 bp, Artificial Sequence
  Description of Artificial Sequence: Synthetic oligonucleotide
gaccgactcctaggagtcggtc

SEQ ID NO: 10829 - DNA, 22 bp, Artificial Sequence
  Description of Artificial Sequence: Synthetic oligonucleotide
gcacgactcctaggagtcgtgc

SEQ ID NO: 10830 - DNA, 22 bp, Artificial Sequence
  Description of Artificial Sequence: Synthetic oligonucleotide
gccagactcctaggagtctggc

SEQ ID NO: 10831 - DNA, 22 bp, Artificial Sequence
  Description of Artificial Sequence: Synthetic oligonucleotide
tcccgactcctaggagtcggga

SEQ ID NO: 10832 - DNA, 22 bp, Artificial Sequence
  Description of Artificial Sequence: Synthetic oligonucleotide
gtccgactcctaggagtcggac

SEQ ID NO: 10833 - DNA, 22 bp, Artificial Sequence
  Description of Artificial Sequence: Synthetic oligonucleotide
gcctgactcctaggagtcaggc

SEQ ID NO: 10834 - DNA, 22 bp, Artificial Sequence
  Description of Artificial Sequence: Synthetic oligonucleotide
gggcgactcctaggagtcgccc

SEQ ID NO: 10835 - DNA, 22 bp, Artificial Sequence
  Description of Artificial Sequence: Synthetic oligonucleotide
aggcgactcctaggagtcgcct

SEQ ID NO: 10836 - DNA, 22 bp, Artificial Sequence
  Description of Artificial Sequence: Synthetic oligonucleotide
gagcgactcctaggagtcgctc

SEQ ID NO: 10837 - DNA, 22 bp, Artificial Sequence
  Description of Artificial Sequence: Synthetic oligonucleotide
ggacgactcctaggagtcgtcc

SEQ ID NO: 10838 - DNA, 22 bp, Artificial Sequence
  Description of Artificial Sequence: Synthetic oligonucleotide
gggagactcctaggagtctccc

SEQ ID NO: 10839 - DNA, 22 bp, Artificial Sequence
  Description of Artificial Sequence: Synthetic oligonucleotide
tggcgactcctaggagtcgcca

SEQ ID NO: 10840 - DNA, 22 bp, Artificial Sequence
  Description of Artificial Sequence: Synthetic oligonucleotide
gtgcgactcctaggagtcgcac

SEQ ID NO: 10841 - DNA, 22 bp, Artificial Sequence
  Description of Artificial Sequence: Synthetic oligonucleotide
gggtgactcctaggagtcaccc

SEQ ID NO: 10842 - DNA, 22 bp, Artificial Sequence
  Description of Artificial Sequence: Synthetic oligonucleotide
acgggactcctaggagtcccgt

SEQ ID NO: 10843 - DNA, 22 bp, Artificial Sequence
  Description of Artificial Sequence: Synthetic oligonucleotide
cagggactcctaggagtccctg

SEQ ID NO: 10844 - DNA, 22 bp, Artificial Sequence
  Description of Artificial Sequence: Synthetic oligonucleotide
ccaggactcctaggagtcctgg

SEQ ID NO: 10845 - DNA, 22 bp, Artificial Sequence
  Description of Artificial Sequence: Synthetic oligonucleotide
ccgagactcctaggagtctcgg

SEQ ID NO: 10846 - DNA, 22 bp, Artificial Sequence
  Description of Artificial Sequence: Synthetic oligonucleotide
tcgggactcctaggagtcccga

SEQ ID NO: 10847 - DNA, 22 bp, Artificial Sequence
  Description of Artificial Sequence: Synthetic oligonucleotide
ctgggactcctaggagtcccag

SEQ ID NO: 10848 - DNA, 22 bp, Artificial Sequence
  Description of Artificial Sequence: Synthetic oligonucleotide
cctggactcctaggagtccagg

SEQ ID NO: 10849 - DNA, 22 bp, Artificial Sequence
  Description of Artificial Sequence: Synthetic oligonucleotide
ccgtgactcctaggagtcacgg

SEQ ID NO: 10850 - DNA, 22 bp, Artificial Sequence
  Description of Artificial Sequence: Synthetic oligonucleotide
cggcgactcctaggagtcgccg

SEQ ID NO: 10851 - DNA, 22 bp, Artificial Sequence
  Description of Artificial Sequence: Synthetic oligonucleotide
cagcgactcctaggagtcgctg

SEQ ID NO: 10852 - DNA, 22 bp, Artificial Sequence
  Description of Artificial Sequence: Synthetic oligonucleotide
cgacgactcctaggagtcgtcg

SEQ ID NO: 10853 - DNA, 22 bp, Artificial Sequence
  Description of Artificial Sequence: Synthetic oligonucleotide
cggagactcctaggagtctccg

SEQ ID NO: 10854 - DNA, 22 bp, Artificial Sequence
  Description of Artificial Sequence: Synthetic oligonucleotide
ctgcgactcctaggagtcgcag

SEQ ID NO: 10855 - DNA, 22 bp, Artificial Sequence
  Description of Artificial Sequence: Synthetic oligonucleotide
cggtgactcctaggagtcaccg

SEQ ID NO: 10856 - DNA, 22 bp, Artificial Sequence
  Description of Artificial Sequence: Synthetic oligonucleotide
cacggactcctaggagtccgtg

SEQ ID NO: 10857 - DNA, 22 bp, Artificial Sequence
  Description of Artificial Sequence: Synthetic oligonucleotide
cccagactcctaggagtctggg

SEQ ID NO: 10858 - DNA, 22 bp, Artificial Sequence
  Description of Artificial Sequence: Synthetic oligonucleotide
ctcggactcctaggagtccgag

SEQ ID NO: 10859 - DNA, 22 bp, Artificial Sequence
  Description of Artificial Sequence: Synthetic oligonucleotide
ccctgactcctaggagtcaggg

SEQ ID NO: 10860 - DNA, 22 bp, Artificial Sequence
  Description of Artificial Sequence: Synthetic oligonucleotide
ccacgactcctaggagtcgtgg

SEQ ID NO: 10861 - DNA, 22 bp, Artificial Sequence
  Description of Artificial Sequence: Synthetic oligonucleotide
agccgactcctaggagtcggct

SEQ ID NO: 10862 - DNA, 22 bp, Artificial Sequence
  Description of Artificial Sequence: Synthetic oligonucleotide
tgccgactcctaggagtcggca

SEQ ID NO: 10863 - DNA, 22 bp, Artificial Sequence
  Description of Artificial Sequence: Synthetic oligonucleotide
gcgagactcctaggagtctcgc

SEQ ID NO: 10864 - DNA, 22 bp, Artificial Sequence
  Description of Artificial Sequence: Synthetic oligonucleotide
gcgtgactcctaggagtcacgc

SEQ ID NO: 10865 - DNA, 22 bp, Artificial Sequence
  Description of Artificial Sequence: Synthetic oligonucleotide
gcaggactcctaggagtcctgc

SEQ ID NO: 10866 - DNA, 22 bp, Artificial Sequence
  Description of Artificial Sequence: Synthetic oligonucleotide
gctggactcctaggagtccagc

SEQ ID NO: 10867 - DNA, 22 bp, Artificial Sequence
  Description of Artificial Sequence: Synthetic oligonucleotide
cgaggactcctaggagtcctcg

SEQ ID NO: 10868 - DNA, 22 bp, Artificial Sequence
  Description of Artificial Sequence: Synthetic oligonucleotide
cgtggactcctaggagtccacg

SEQ ID NO: 10869 - DNA, 22 bp, Artificial Sequence
  Description of Artificial Sequence: Synthetic oligonucleotide
caccgactcctaggagtcggtg

SEQ ID NO: 10870 - DNA, 22 bp, Artificial Sequence
  Description of Artificial Sequence: Synthetic oligonucleotide
ctccgactcctaggagtcggag

SEQ ID NO: 10871 - DNA, 22 bp, Artificial Sequence
  Description of Artificial Sequence: Synthetic oligonucleotide
gcgggactcctaggagtcccgc

SEQ ID NO: 10872 - DNA, 22 bp, Artificial Sequence
  Description of Artificial Sequence: Synthetic oligonucleotide
gagggactcctaggagtccctc

SEQ ID NO: 10873 - DNA, 22 bp, Artificial Sequence
  Description of Artificial Sequence: Synthetic oligonucleotide
gtgggactcctaggagtcccac

SEQ ID NO: 10874 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactccatggagtcnnnn

SEQ ID NO: 10875 - DNA, 22 bp, Artificial Sequence
  Description of Artificial Sequence: Synthetic oligonucleotide
ggcggactccatggagtccgcc

SEQ ID NO: 10876 - DNA, 22 bp, Artificial Sequence
  Description of Artificial Sequence: Synthetic oligonucleotide
agcggactccatggagtccgct

SEQ ID NO: 10877 - DNA, 22 bp, Artificial Sequence
  Description of Artificial Sequence: Synthetic oligonucleotide
gacggactccatggagtccgtc

SEQ ID NO: 10878 - DNA, 22 bp, Artificial Sequence
  Description of Artificial Sequence: Synthetic oligonucleotide
ggaggactccatggagtcctcc

SEQ ID NO: 10879 - DNA, 22 bp, Artificial Sequence
  Description of Artificial Sequence: Synthetic oligonucleotide
ggcagactccatggagtctgcc

SEQ ID NO: 10880 - DNA, 22 bp, Artificial Sequence
  Description of Artificial Sequence: Synthetic oligonucleotide
tgcggactccatggagtccgca

SEQ ID NO: 10881 - DNA, 22 bp, Artificial Sequence
  Description of Artificial Sequence: Synthetic oligonucleotide
gtcggactccatggagtccgac

SEQ ID NO: 10882 - DNA, 22 bp, Artificial Sequence
  Description of Artificial Sequence: Synthetic oligonucleotide
ggtggactccatggagtccacc

SEQ ID NO: 10883 - DNA, 22 bp, Artificial Sequence
  Description of Artificial Sequence: Synthetic oligonucleotide
ggctgactccatggagtcagcc

SEQ ID NO: 10884 - DNA, 22 bp, Artificial Sequence
  Description of Artificial Sequence: Synthetic oligonucleotide
gcccgactccatggagtcgggc

SEQ ID NO: 10885 - DNA, 22 bp, Artificial Sequence
  Description of Artificial Sequence: Synthetic oligonucleotide
acccgactccatggagtcgggt

SEQ ID NO: 10886 - DNA, 22 bp, Artificial Sequence
  Description of Artificial Sequence: Synthetic oligonucleotide
gaccgactccatggagtcggtc

SEQ ID NO: 10887 - DNA, 22 bp, Artificial Sequence
  Description of Artificial Sequence: Synthetic oligonucleotide
gcacgactccatggagtcgtgc

SEQ ID NO: 10888 - DNA, 22 bp, Artificial Sequence
  Description of Artificial Sequence: Synthetic oligonucleotide
gccagactccatggagtctggc

SEQ ID NO: 10889 - DNA, 22 bp, Artificial Sequence
  Description of Artificial Sequence: Synthetic oligonucleotide
tcccgactccatggagtcggga

SEQ ID NO: 10890 - DNA, 22 bp, Artificial Sequence
  Description of Artificial Sequence: Synthetic oligonucleotide
gtccgactccatggagtcggac

SEQ ID NO: 10891 - DNA, 22 bp, Artificial Sequence
  Description of Artificial Sequence: Synthetic oligonucleotide
gcctgactccatggagtcaggc

SEQ ID NO: 10892 - DNA, 22 bp, Artificial Sequence
  Description of Artificial Sequence: Synthetic oligonucleotide
gggcgactccatggagtcgccc

SEQ ID NO: 10893 - DNA, 22 bp, Artificial Sequence
  Description of Artificial Sequence: Synthetic oligonucleotide
aggcgactccatggagtcgcct

SEQ ID NO: 10894 - DNA, 22 bp, Artificial Sequence
  Description of Artificial Sequence: Synthetic oligonucleotide
gagcgactccatggagtcgctc

SEQ ID NO: 10895 - DNA, 22 bp, Artificial Sequence
  Description of Artificial Sequence: Synthetic oligonucleotide
ggacgactccatggagtcgtcc

SEQ ID NO: 10896 - DNA, 22 bp, Artificial Sequence
  Description of Artificial Sequence: Synthetic oligonucleotide
gggagactccatggagtctccc

SEQ ID NO: 10897 - DNA, 22 bp, Artificial Sequence
  Description of Artificial Sequence: Synthetic oligonucleotide
tggcgactccatggagtcgcca

SEQ ID NO: 10898 - DNA, 22 bp, Artificial Sequence
  Description of Artificial Sequence: Synthetic oligonucleotide
gtgcgactccatggagtcgcac

SEQ ID NO: 10899 - DNA, 22 bp, Artificial Sequence
  Description of Artificial Sequence: Synthetic oligonucleotide
gggtgactccatggagtcaccc

SEQ ID NO: 10900 - DNA, 22 bp, Artificial Sequence
  Description of Artificial Sequence: Synthetic oligonucleotide
acgggactccatggagtcccgt

SEQ ID NO: 10901 - DNA, 22 bp, Artificial Sequence
  Description of Artificial Sequence: Synthetic oligonucleotide
cagggactccatggagtccctg

SEQ ID NO: 10902 - DNA, 22 bp, Artificial Sequence
  Description of Artificial Sequence: Synthetic oligonucleotide
ccaggactccatggagtcctgg

SEQ ID NO: 10903 - DNA, 22 bp, Artificial Sequence
  Description of Artificial Sequence: Synthetic oligonucleotide
ccgagactccatggagtctcgg

SEQ ID NO: 10904 - DNA, 22 bp, Artificial Sequence
  Description of Artificial Sequence: Synthetic oligonucleotide
tcgggactccatggagtcccga

SEQ ID NO: 10905 - DNA, 22 bp, Artificial Sequence
  Description of Artificial Sequence: Synthetic oligonucleotide
ctgggactccatggagtcccag

SEQ ID NO: 10906 - DNA, 22 bp, Artificial Sequence
  Description of Artificial Sequence: Synthetic oligonucleotide
cctggactccatggagtccagg

SEQ ID NO: 10907 - DNA, 22 bp, Artificial Sequence
  Description of Artificial Sequence: Synthetic oligonucleotide
ccgtgactccatggagtcacgg

SEQ ID NO: 10908 - DNA, 22 bp, Artificial Sequence
  Description of Artificial Sequence: Synthetic oligonucleotide
cggcgactccatggagtcgccg

SEQ ID NO: 10909 - DNA, 22 bp, Artificial Sequence
  Description of Artificial Sequence: Synthetic oligonucleotide
cagcgactccatggagtcgctg

SEQ ID NO: 10910 - DNA, 22 bp, Artificial Sequence
  Description of Artificial Sequence: Synthetic oligonucleotide
cgacgactccatggagtcgtcg

SEQ ID NO: 10911 - DNA, 22 bp, Artificial Sequence
  Description of Artificial Sequence: Synthetic oligonucleotide
cggagactccatggagtctccg

SEQ ID NO: 10912 - DNA, 22 bp, Artificial Sequence
  Description of Artificial Sequence: Synthetic oligonucleotide
ctgcgactccatggagtcgcag

SEQ ID NO: 10913 - DNA, 22 bp, Artificial Sequence
  Description of Artificial Sequence: Synthetic oligonucleotide
cggtgactccatggagtcaccg

SEQ ID NO: 10914 - DNA, 22 bp, Artificial Sequence
  Description of Artificial Sequence: Synthetic oligonucleotide
cacggactccatggagtccgtg

SEQ ID NO: 10915 - DNA, 22 bp, Artificial Sequence
  Description of Artificial Sequence: Synthetic oligonucleotide
cccagactccatggagtctggg

SEQ ID NO: 10916 - DNA, 22 bp, Artificial Sequence
  Description of Artificial Sequence: Synthetic oligonucleotide
ctcggactccatggagtccgag

SEQ ID NO: 10917 - DNA, 22 bp, Artificial Sequence
  Description of Artificial Sequence: Synthetic oligonucleotide
ccctgactccatggagtcaggg

SEQ ID NO: 10918 - DNA, 22 bp, Artificial Sequence
  Description of Artificial Sequence: Synthetic oligonucleotide
ccacgactccatggagtcgtgg

SEQ ID NO: 10919 - DNA, 22 bp, Artificial Sequence
  Description of Artificial Sequence: Synthetic oligonucleotide
agccgactccatggagtcggct

SEQ ID NO: 10920 - DNA, 22 bp, Artificial Sequence
  Description of Artificial Sequence: Synthetic oligonucleotide
tgccgactccatggagtcggca

SEQ ID NO: 10921 - DNA, 22 bp, Artificial Sequence
  Description of Artificial Sequence: Synthetic oligonucleotide
gcgagactccatggagtctcgc

SEQ ID NO: 10922 - DNA, 22 bp, Artificial Sequence
  Description of Artificial Sequence: Synthetic oligonucleotide
gcgtgactccatggagtcacgc

SEQ ID NO: 10923 - DNA, 22 bp, Artificial Sequence
  Description of Artificial Sequence: Synthetic oligonucleotide
gcaggactccatggagtcctgc

SEQ ID NO: 10924 - DNA, 22 bp, Artificial Sequence
  Description of Artificial Sequence: Synthetic oligonucleotide
gctggactccatggagtccagc

SEQ ID NO: 10925 - DNA, 22 bp, Artificial Sequence
  Description of Artificial Sequence: Synthetic oligonucleotide
cgaggactccatggagtcctcg

SEQ ID NO: 10926 - DNA, 22 bp, Artificial Sequence
  Description of Artificial Sequence: Synthetic oligonucleotide
cgtggactccatggagtccacg

SEQ ID NO: 10927 - DNA, 22 bp, Artificial Sequence
  Description of Artificial Sequence: Synthetic oligonucleotide
caccgactccatggagtcggtg

SEQ ID NO: 10928 - DNA, 22 bp, Artificial Sequence
  Description of Artificial Sequence: Synthetic oligonucleotide
ctccgactccatggagtcggag

SEQ ID NO: 10929 - DNA, 22 bp, Artificial Sequence
  Description of Artificial Sequence: Synthetic oligonucleotide
gcgggactccatggagtcccgc

SEQ ID NO: 10930 - DNA, 22 bp, Artificial Sequence
  Description of Artificial Sequence: Synthetic oligonucleotide
gagggactccatggagtccctc

SEQ ID NO: 10931 - DNA, 22 bp, Artificial Sequence
  Description of Artificial Sequence: Synthetic oligonucleotide
gtgggactccatggagtcccac

SEQ ID NO: 10932 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactctcgagagtcnnnn

SEQ ID NO: 10933 - DNA, 22 bp, Artificial Sequence
  Description of Artificial Sequence: Synthetic oligonucleotide
ggcggactctcgagagtccgcc

SEQ ID NO: 10934 - DNA, 22 bp, Artificial Sequence
  Description of Artificial Sequence: Synthetic oligonucleotide
agcggactctcgagagtccgct

SEQ ID NO: 10935 - DNA, 22 bp, Artificial Sequence
  Description of Artificial Sequence: Synthetic oligonucleotide
gacggactctcgagagtccgtc

SEQ ID NO: 10936 - DNA, 22 bp, Artificial Sequence
  Description of Artificial Sequence: Synthetic oligonucleotide
ggaggactctcgagagtcctcc

SEQ ID NO: 10937 - DNA, 22 bp, Artificial Sequence
  Description of Artificial Sequence: Synthetic oligonucleotide
ggcagactctcgagagtctgcc

SEQ ID NO: 10938 - DNA, 22 bp, Artificial Sequence
  Description of Artificial Sequence: Synthetic oligonucleotide
tgcggactctcgagagtccgca

SEQ ID NO: 10939 - DNA, 22 bp, Artificial Sequence
  Description of Artificial Sequence: Synthetic oligonucleotide
gtcggactctcgagagtccgac

SEQ ID NO: 10940 - DNA, 22 bp, Artificial Sequence
  Description of Artificial Sequence: Synthetic oligonucleotide
ggtggactctcgagagtccacc

SEQ ID NO: 10941 - DNA, 22 bp, Artificial Sequence
  Description of Artificial Sequence: Synthetic oligonucleotide
ggctgactctcgagagtcagcc

SEQ ID NO: 10942 - DNA, 22 bp, Artificial Sequence
  Description of Artificial Sequence: Synthetic oligonucleotide
gcccgactctcgagagtcgggc

SEQ ID NO: 10943 - DNA, 22 bp, Artificial Sequence
  Description of Artificial Sequence: Synthetic oligonucleotide
acccgactctcgagagtcgggt

SEQ ID NO: 10944 - DNA, 22 bp, Artificial Sequence
  Description of Artificial Sequence: Synthetic oligonucleotide
gaccgactctcgagagtcggtc

SEQ ID NO: 10945 - DNA, 22 bp, Artificial Sequence
  Description of Artificial Sequence: Synthetic oligonucleotide
gcacgactctcgagagtcgtgc

SEQ ID NO: 10946 - DNA, 22 bp, Artificial Sequence
  Description of Artificial Sequence: Synthetic oligonucleotide
gccagactctcgagagtctggc

SEQ ID NO: 10947 - DNA, 22 bp, Artificial Sequence
  Description of Artificial Sequence: Synthetic oligonucleotide
tcccgactctcgagagtcggga

SEQ ID NO: 10948 - DNA, 22 bp, Artificial Sequence
  Description of Artificial Sequence: Synthetic oligonucleotide
gtccgactctcgagagtcggac

SEQ ID NO: 10949 - DNA, 22 bp, Artificial Sequence
  Description of Artificial Sequence: Synthetic oligonucleotide
gcctgactctcgagagtcaggc

SEQ ID NO: 10950 - DNA, 22 bp, Artificial Sequence
  Description of Artificial Sequence: Synthetic oligonucleotide
gggcgactctcgagagtcgccc

SEQ ID NO: 10951 - DNA, 22 bp, Artificial Sequence
  Description of Artificial Sequence: Synthetic oligonucleotide
aggcgactctcgagagtcgcct

SEQ ID NO: 10952 - DNA, 22 bp, Artificial Sequence
  Description of Artificial Sequence: Synthetic oligonucleotide
gagcgactctcgagagtcgctc

SEQ ID NO: 10953 - DNA, 22 bp, Artificial Sequence
  Description of Artificial Sequence: Synthetic oligonucleotide
ggacgactctcgagagtcgtcc

SEQ ID NO: 10954 - DNA, 22 bp, Artificial Sequence
  Description of Artificial Sequence: Synthetic oligonucleotide
gggagactctcgagagtctccc

SEQ ID NO: 10955 - DNA, 22 bp, Artificial Sequence
  Description of Artificial Sequence: Synthetic oligonucleotide
tggcgactctcgagagtcgcca

SEQ ID NO: 10956 - DNA, 22 bp, Artificial Sequence
  Description of Artificial Sequence: Synthetic oligonucleotide
gtgcgactctcgagagtcgcac

SEQ ID NO: 10957 - DNA, 22 bp, Artificial Sequence
  Description of Artificial Sequence: Synthetic oligonucleotide
gggtgactctcgagagtcaccc

SEQ ID NO: 10958 - DNA, 22 bp, Artificial Sequence
  Description of Artificial Sequence: Synthetic oligonucleotide
acgggactctcgagagtcccgt

SEQ ID NO: 10959 - DNA, 22 bp, Artificial Sequence
  Description of Artificial Sequence: Synthetic oligonucleotide
cagggactctcgagagtccctg

SEQ ID NO: 10960 - DNA, 22 bp, Artificial Sequence
  Description of Artificial Sequence: Synthetic oligonucleotide
ccaggactctcgagagtcctgg

SEQ ID NO: 10961 - DNA, 22 bp, Artificial Sequence
  Description of Artificial Sequence: Synthetic oligonucleotide
ccgagactctcgagagtctcgg

SEQ ID NO: 10962 - DNA, 22 bp, Artificial Sequence
  Description of Artificial Sequence: Synthetic oligonucleotide
tcgggactctcgagagtcccga

SEQ ID NO: 10963 - DNA, 22 bp, Artificial Sequence
  Description of Artificial Sequence: Synthetic oligonucleotide
ctgggactctcgagagtcccag

SEQ ID NO: 10964 - DNA, 22 bp, Artificial Sequence
  Description of Artificial Sequence: Synthetic oligonucleotide
cctggactctcgagagtccagg

SEQ ID NO: 10965 - DNA, 22 bp, Artificial Sequence
  Description of Artificial Sequence: Synthetic oligonucleotide
ccgtgactctcgagagtcacgg

SEQ ID NO: 10966 - DNA, 22 bp, Artificial Sequence
  Description of Artificial Sequence: Synthetic oligonucleotide
cggcgactctcgagagtcgccg

SEQ ID NO: 10967 - DNA, 22 bp, Artificial Sequence
  Description of Artificial Sequence: Synthetic oligonucleotide
cagcgactctcgagagtcgctg

SEQ ID NO: 10968 - DNA, 22 bp, Artificial Sequence
  Description of Artificial Sequence: Synthetic oligonucleotide
cgacgactctcgagagtcgtcg

SEQ ID NO: 10969 - DNA, 22 bp, Artificial Sequence
  Description of Artificial Sequence: Synthetic oligonucleotide
cggagactctcgagagtctccg

SEQ ID NO: 10970 - DNA, 22 bp, Artificial Sequence
  Description of Artificial Sequence: Synthetic oligonucleotide
ctgcgactctcgagagtcgcag

SEQ ID NO: 10971 - DNA, 22 bp, Artificial Sequence
  Description of Artificial Sequence: Synthetic oligonucleotide
cggtgactctcgagagtcaccg

SEQ ID NO: 10972 - DNA, 22 bp, Artificial Sequence
  Description of Artificial Sequence: Synthetic oligonucleotide
cacggactctcgagagtccgtg

SEQ ID NO: 10973 - DNA, 22 bp, Artificial Sequence
  Description of Artificial Sequence: Synthetic oligonucleotide
cccagactctcgagagtctggg

SEQ ID NO: 10974 - DNA, 22 bp, Artificial Sequence
  Description of Artificial Sequence: Synthetic oligonucleotide
ctcggactctcgagagtccgag

SEQ ID NO: 10975 - DNA, 22 bp, Artificial Sequence
  Description of Artificial Sequence: Synthetic oligonucleotide
ccctgactctcgagagtcaggg

SEQ ID NO: 10976 - DNA, 22 bp, Artificial Sequence
  Description of Artificial Sequence: Synthetic oligonucleotide
ccacgactctcgagagtcgtgg

SEQ ID NO: 10977 - DNA, 22 bp, Artificial Sequence
  Description of Artificial Sequence: Synthetic oligonucleotide
agccgactctcgagagtcggct

SEQ ID NO: 10978 - DNA, 22 bp, Artificial Sequence
  Description of Artificial Sequence: Synthetic oligonucleotide
tgccgactctcgagagtcggca

SEQ ID NO: 10979 - DNA, 22 bp, Artificial Sequence
  Description of Artificial Sequence: Synthetic oligonucleotide
gcgagactctcgagagtctcgc

SEQ ID NO: 10980 - DNA, 22 bp, Artificial Sequence
  Description of Artificial Sequence: Synthetic oligonucleotide
gcgtgactctcgagagtcacgc

SEQ ID NO: 10981 - DNA, 22 bp, Artificial Sequence
  Description of Artificial Sequence: Synthetic oligonucleotide
gcaggactctcgagagtcctgc

SEQ ID NO: 10982 - DNA, 22 bp, Artificial Sequence
  Description of Artificial Sequence: Synthetic oligonucleotide
gctggactctcgagagtccagc

SEQ ID NO: 10983 - DNA, 22 bp, Artificial Sequence
  Description of Artificial Sequence: Synthetic oligonucleotide
cgaggactctcgagagtcctcg

SEQ ID NO: 10984 - DNA, 22 bp, Artificial Sequence
  Description of Artificial Sequence: Synthetic oligonucleotide
cgtggactctcgagagtccacg

SEQ ID NO: 10985 - DNA, 22 bp, Artificial Sequence
  Description of Artificial Sequence: Synthetic oligonucleotide
caccgactctcgagagtcggtg

SEQ ID NO: 10986 - DNA, 22 bp, Artificial Sequence
  Description of Artificial Sequence: Synthetic oligonucleotide
ctccgactctcgagagtcggag

SEQ ID NO: 10987 - DNA, 22 bp, Artificial Sequence
  Description of Artificial Sequence: Synthetic oligonucleotide
gcgggactctcgagagtcccgc

SEQ ID NO: 10988 - DNA, 22 bp, Artificial Sequence
  Description of Artificial Sequence: Synthetic oligonucleotide
gagggactctcgagagtccctc

SEQ ID NO: 10989 - DNA, 22 bp, Artificial Sequence
  Description of Artificial Sequence: Synthetic oligonucleotide
gtgggactctcgagagtcccac

SEQ ID NO: 10990 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcagctgagtcnnnn

SEQ ID NO: 10991 - DNA, 22 bp, Artificial Sequence
  Description of Artificial Sequence: Synthetic oligonucleotide
ggcggactcagctgagtccgcc

SEQ ID NO: 10992 - DNA, 22 bp, Artificial Sequence
  Description of Artificial Sequence: Synthetic oligonucleotide
agcggactcagctgagtccgct

SEQ ID NO: 10993 - DNA, 22 bp, Artificial Sequence
  Description of Artificial Sequence: Synthetic oligonucleotide
gacggactcagctgagtccgtc

SEQ ID NO: 10994 - DNA, 22 bp, Artificial Sequence
  Description of Artificial Sequence: Synthetic oligonucleotide
ggaggactcagctgagtcctcc

SEQ ID NO: 10995 - DNA, 22 bp, Artificial Sequence
  Description of Artificial Sequence: Synthetic oligonucleotide
ggcagactcagctgagtctgcc

SEQ ID NO: 10996 - DNA, 22 bp, Artificial Sequence
  Description of Artificial Sequence: Synthetic oligonucleotide
tgcggactcagctgagtccgca

SEQ ID NO: 10997 - DNA, 22 bp, Artificial Sequence
  Description of Artificial Sequence: Synthetic oligonucleotide
gtcggactcagctgagtccgac

SEQ ID NO: 10998 - DNA, 22 bp, Artificial Sequence
  Description of Artificial Sequence: Synthetic oligonucleotide
ggtggactcagctgagtccacc

SEQ ID NO: 10999 - DNA, 22 bp, Artificial Sequence
  Description of Artificial Sequence: Synthetic oligonucleotide
ggctgactcagctgagtcagcc

SEQ ID NO: 11000 - DNA, 22 bp, Artificial Sequence
  Description of Artificial Sequence: Synthetic oligonucleotide
gcccgactcagctgagtcgggc

SEQ ID NO: 11001 - DNA, 22 bp, Artificial Sequence
  Description of Artificial Sequence: Synthetic oligonucleotide
acccgactcagctgagtcgggt

SEQ ID NO: 11002 - DNA, 22 bp, Artificial Sequence
  Description of Artificial Sequence: Synthetic oligonucleotide
gaccgactcagctgagtcggtc

SEQ ID NO: 11003 - DNA, 22 bp, Artificial Sequence
  Description of Artificial Sequence: Synthetic oligonucleotide
gcacgactcagctgagtcgtgc

SEQ ID NO: 11004 - DNA, 22 bp, Artificial Sequence
  Description of Artificial Sequence: Synthetic oligonucleotide
gccagactcagctgagtctggc

SEQ ID NO: 11005 - DNA, 22 bp, Artificial Sequence
  Description of Artificial Sequence: Synthetic oligonucleotide
tcccgactcagctgagtcggga

SEQ ID NO: 11006 - DNA, 22 bp, Artificial Sequence
  Description of Artificial Sequence: Synthetic oligonucleotide
gtccgactcagctgagtcggac

SEQ ID NO: 11007 - DNA, 22 bp, Artificial Sequence
  Description of Artificial Sequence: Synthetic oligonucleotide
gcctgactcagctgagtcaggc

SEQ ID NO: 11008 - DNA, 22 bp, Artificial Sequence
  Description of Artificial Sequence: Synthetic oligonucleotide
gggcgactcagctgagtcgccc

SEQ ID NO: 11009 - DNA, 22 bp, Artificial Sequence
  Description of Artificial Sequence: Synthetic oligonucleotide
aggcgactcagctgagtcgcct

SEQ ID NO: 11010 - DNA, 22 bp, Artificial Sequence
  Description of Artificial Sequence: Synthetic oligonucleotide
gagcgactcagctgagtcgctc

SEQ ID NO: 11011 - DNA, 22 bp, Artificial Sequence
  Description of Artificial Sequence: Synthetic oligonucleotide
ggacgactcagctgagtcgtcc

SEQ ID NO: 11012 - DNA, 22 bp, Artificial Sequence
  Description of Artificial Sequence: Synthetic oligonucleotide
gggagactcagctgagtctccc

SEQ ID NO: 11013 - DNA, 22 bp, Artificial Sequence
  Description of Artificial Sequence: Synthetic oligonucleotide
tggcgactcagctgagtcgcca

SEQ ID NO: 11014 - DNA, 22 bp, Artificial Sequence
  Description of Artificial Sequence: Synthetic oligonucleotide
gtgcgactcagctgagtcgcac

SEQ ID NO: 11015 - DNA, 22 bp, Artificial Sequence
  Description of Artificial Sequence: Synthetic oligonucleotide
gggtgactcagctgagtcaccc

SEQ ID NO: 11016 - DNA, 22 bp, Artificial Sequence
  Description of Artificial Sequence: Synthetic oligonucleotide
acgggactcagctgagtcccgt

SEQ ID NO: 11017 - DNA, 22 bp, Artificial Sequence
  Description of Artificial Sequence: Synthetic oligonucleotide
cagggactcagctgagtccctg

SEQ ID NO: 11018 - DNA, 22 bp, Artificial Sequence
  Description of Artificial Sequence: Synthetic oligonucleotide
ccaggactcagctgagtcctgg

SEQ ID NO: 11019 - DNA, 22 bp, Artificial Sequence
  Description of Artificial Sequence: Synthetic oligonucleotide
ccgagactcagctgagtctcgg

SEQ ID NO: 11020 - DNA, 22 bp, Artificial Sequence
  Description of Artificial Sequence: Synthetic oligonucleotide
tcgggactcagctgagtcccga

SEQ ID NO: 11021 - DNA, 22 bp, Artificial Sequence
  Description of Artificial Sequence: Synthetic oligonucleotide
ctgggactcagctgagtcccag

SEQ ID NO: 11022 - DNA, 22 bp, Artificial Sequence
  Description of Artificial Sequence: Synthetic oligonucleotide
cctggactcagctgagtccagg

SEQ ID NO: 11023 - DNA, 22 bp, Artificial Sequence
  Description of Artificial Sequence: Synthetic oligonucleotide
ccgtgactcagctgagtcacgg

SEQ ID NO: 11024 - DNA, 22 bp, Artificial Sequence
  Description of Artificial Sequence: Synthetic oligonucleotide
cggcgactcagctgagtcgccg

SEQ ID NO: 11025 - DNA, 22 bp, Artificial Sequence
  Description of Artificial Sequence: Synthetic oligonucleotide
cagcgactcagctgagtcgctg

SEQ ID NO: 11026 - DNA, 22 bp, Artificial Sequence
  Description of Artificial Sequence: Synthetic oligonucleotide
cgacgactcagctgagtcgtcg

SEQ ID NO: 11027 - DNA, 22 bp, Artificial Sequence
  Description of Artificial Sequence: Synthetic oligonucleotide
cggagactcagctgagtctccg

SEQ ID NO: 11028 - DNA, 22 bp, Artificial Sequence
  Description of Artificial Sequence: Synthetic oligonucleotide
ctgcgactcagctgagtcgcag

SEQ ID NO: 11029 - DNA, 22 bp, Artificial Sequence
  Description of Artificial Sequence: Synthetic oligonucleotide
cggtgactcagctgagtcaccg

SEQ ID NO: 11030 - DNA, 22 bp, Artificial Sequence
  Description of Artificial Sequence: Synthetic oligonucleotide
cacggactcagctgagtccgtg

SEQ ID NO: 11031 - DNA, 22 bp, Artificial Sequence
  Description of Artificial Sequence: Synthetic oligonucleotide
cccagactcagctgagtctggg

SEQ ID NO: 11032 - DNA, 22 bp, Artificial Sequence
  Description of Artificial Sequence: Synthetic oligonucleotide
ctcggactcagctgagtccgag

SEQ ID NO: 11033 - DNA, 22 bp, Artificial Sequence
  Description of Artificial Sequence: Synthetic oligonucleotide
ccctgactcagctgagtcaggg

SEQ ID NO: 11034 - DNA, 22 bp, Artificial Sequence
  Description of Artificial Sequence: Synthetic oligonucleotide
ccacgactcagctgagtcgtgg

SEQ ID NO: 11035 - DNA, 22 bp, Artificial Sequence
  Description of Artificial Sequence: Synthetic oligonucleotide
agccgactcagctgagtcggct

SEQ ID NO: 11036 - DNA, 22 bp, Artificial Sequence
  Description of Artificial Sequence: Synthetic oligonucleotide
tgccgactcagctgagtcggca

SEQ ID NO: 11037 - DNA, 22 bp, Artificial Sequence
  Description of Artificial Sequence: Synthetic oligonucleotide
gcgagactcagctgagtctcgc

SEQ ID NO: 11038 - DNA, 22 bp, Artificial Sequence
  Description of Artificial Sequence: Synthetic oligonucleotide
gcgtgactcagctgagtcacgc

SEQ ID NO: 11039 - DNA, 22 bp, Artificial Sequence
  Description of Artificial Sequence: Synthetic oligonucleotide
gcaggactcagctgagtcctgc

SEQ ID NO: 11040 - DNA, 22 bp, Artificial Sequence
  Description of Artificial Sequence: Synthetic oligonucleotide
gctggactcagctgagtccagc

SEQ ID NO: 11041 - DNA, 22 bp, Artificial Sequence
  Description of Artificial Sequence: Synthetic oligonucleotide
cgaggactcagctgagtcctcg

SEQ ID NO: 11042 - DNA, 22 bp, Artificial Sequence
  Description of Artificial Sequence: Synthetic oligonucleotide
cgtggactcagctgagtccacg

SEQ ID NO: 11043 - DNA, 22 bp, Artificial Sequence
  Description of Artificial Sequence: Synthetic oligonucleotide
caccgactcagctgagtcggtg

SEQ ID NO: 11044 - DNA, 22 bp, Artificial Sequence
  Description of Artificial Sequence: Synthetic oligonucleotide
ctccgactcagctgagtcggag

SEQ ID NO: 11045 - DNA, 22 bp, Artificial Sequence
  Description of Artificial Sequence: Synthetic oligonucleotide
gcgggactcagctgagtcccgc

SEQ ID NO: 11046 - DNA, 22 bp, Artificial Sequence
  Description of Artificial Sequence: Synthetic oligonucleotide
gagggactcagctgagtccctc

SEQ ID NO: 11047 - DNA, 22 bp, Artificial Sequence
  Description of Artificial Sequence: Synthetic oligonucleotide
gtgggactcagctgagtcccac

SEQ ID NO: 11048 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcaattgagtcnnnn

SEQ ID NO: 11049 - DNA, 22 bp, Artificial Sequence
  Description of Artificial Sequence: Synthetic oligonucleotide
ggcggactcaattgagtccgcc

SEQ ID NO: 11050 - DNA, 22 bp, Artificial Sequence
  Description of Artificial Sequence: Synthetic oligonucleotide
agcggactcaattgagtccgct

SEQ ID NO: 11051 - DNA, 22 bp, Artificial Sequence
  Description of Artificial Sequence: Synthetic oligonucleotide
gacggactcaattgagtccgtc

SEQ ID NO: 11052 - DNA, 22 bp, Artificial Sequence
  Description of Artificial Sequence: Synthetic oligonucleotide
ggaggactcaattgagtcctcc

SEQ ID NO: 11053 - DNA, 22 bp, Artificial Sequence
  Description of Artificial Sequence: Synthetic oligonucleotide
ggcagactcaattgagtctgcc

SEQ ID NO: 11054 - DNA, 22 bp, Artificial Sequence
  Description of Artificial Sequence: Synthetic oligonucleotide
tgcggactcaattgagtccgca

SEQ ID NO: 11055 - DNA, 22 bp, Artificial Sequence
  Description of Artificial Sequence: Synthetic oligonucleotide
gtcggactcaattgagtccgac

SEQ ID NO: 11056 - DNA, 22 bp, Artificial Sequence
  Description of Artificial Sequence: Synthetic oligonucleotide
ggtggactcaattgagtccacc

SEQ ID NO: 11057 - DNA, 22 bp, Artificial Sequence
  Description of Artificial Sequence: Synthetic oligonucleotide
ggctgactcaattgagtcagcc

SEQ ID NO: 11058 - DNA, 22 bp, Artificial Sequence
  Description of Artificial Sequence: Synthetic oligonucleotide
gcccgactcaattgagtcgggc

SEQ ID NO: 11059 - DNA, 22 bp, Artificial Sequence
  Description of Artificial Sequence: Synthetic oligonucleotide
acccgactcaattgagtcgggt

SEQ ID NO: 11060 - DNA, 22 bp, Artificial Sequence
  Description of Artificial Sequence: Synthetic oligonucleotide
gaccgactcaattgagtcggtc

SEQ ID NO: 11061 - DNA, 22 bp, Artificial Sequence
  Description of Artificial Sequence: Synthetic oligonucleotide
gcacgactcaattgagtcgtgc

SEQ ID NO: 11062 - DNA, 22 bp, Artificial Sequence
  Description of Artificial Sequence: Synthetic oligonucleotide
gccagactcaattgagtctggc

SEQ ID NO: 11063 - DNA, 22 bp, Artificial Sequence
  Description of Artificial Sequence: Synthetic oligonucleotide
tcccgactcaattgagtcggga

SEQ ID NO: 11064 - DNA, 22 bp, Artificial Sequence
  Description of Artificial Sequence: Synthetic oligonucleotide
gtccgactcaattgagtcggac

SEQ ID NO: 11065 - DNA, 22 bp, Artificial Sequence
  Description of Artificial Sequence: Synthetic oligonucleotide
gcctgactcaattgagtcaggc

SEQ ID NO: 11066 - DNA, 22 bp, Artificial Sequence
  Description of Artificial Sequence: Synthetic oligonucleotide
gggcgactcaattgagtcgccc

SEQ ID NO: 11067 - DNA, 22 bp, Artificial Sequence
  Description of Artificial Sequence: Synthetic oligonucleotide
aggcgactcaattgagtcgcct

SEQ ID NO: 11068 - DNA, 22 bp, Artificial Sequence
  Description of Artificial Sequence: Synthetic oligonucleotide
gagcgactcaattgagtcgctc

SEQ ID NO: 11069 - DNA, 22 bp, Artificial Sequence
  Description of Artificial Sequence: Synthetic oligonucleotide
ggacgactcaattgagtcgtcc

SEQ ID NO: 11070 - DNA, 22 bp, Artificial Sequence
  Description of Artificial Sequence: Synthetic oligonucleotide
gggagactcaattgagtctccc

SEQ ID NO: 11071 - DNA, 22 bp, Artificial Sequence
  Description of Artificial Sequence: Synthetic oligonucleotide
tggcgactcaattgagtcgcca

SEQ ID NO: 11072 - DNA, 22 bp, Artificial Sequence
  Description of Artificial Sequence: Synthetic oligonucleotide
gtgcgactcaattgagtcgcac

SEQ ID NO: 11073 - DNA, 22 bp, Artificial Sequence
  Description of Artificial Sequence: Synthetic oligonucleotide
gggtgactcaattgagtcaccc

SEQ ID NO: 11074 - DNA, 22 bp, Artificial Sequence
  Description of Artificial Sequence: Synthetic oligonucleotide
acgggactcaattgagtcccgt

SEQ ID NO: 11075 - DNA, 22 bp, Artificial Sequence
  Description of Artificial Sequence: Synthetic oligonucleotide
cagggactcaattgagtccctg

SEQ ID NO: 11076 - DNA, 22 bp, Artificial Sequence
  Description of Artificial Sequence: Synthetic oligonucleotide
ccaggactcaattgagtcctgg

SEQ ID NO: 11077 - DNA, 22 bp, Artificial Sequence
  Description of Artificial Sequence: Synthetic oligonucleotide
ccgagactcaattgagtctcgg

SEQ ID NO: 11078 - DNA, 22 bp, Artificial Sequence
  Description of Artificial Sequence: Synthetic oligonucleotide
tcgggactcaattgagtcccga

SEQ ID NO: 11079 - DNA, 22 bp, Artificial Sequence
  Description of Artificial Sequence: Synthetic oligonucleotide
ctgggactcaattgagtcccag

SEQ ID NO: 11080 - DNA, 22 bp, Artificial Sequence
  Description of Artificial Sequence: Synthetic oligonucleotide
cctggactcaattgagtccagg

SEQ ID NO: 11081 - DNA, 22 bp, Artificial Sequence
  Description of Artificial Sequence: Synthetic oligonucleotide
ccgtgactcaattgagtcacgg

SEQ ID NO: 11082 - DNA, 22 bp, Artificial Sequence
  Description of Artificial Sequence: Synthetic oligonucleotide
cggcgactcaattgagtcgccg

SEQ ID NO: 11083 - DNA, 22 bp, Artificial Sequence
  Description of Artificial Sequence: Synthetic oligonucleotide
cagcgactcaattgagtcgctg

SEQ ID NO: 11084 - DNA, 22 bp, Artificial Sequence
  Description of Artificial Sequence: Synthetic oligonucleotide
cgacgactcaattgagtcgtcg

SEQ ID NO: 11085 - DNA, 22 bp, Artificial Sequence
  Description of Artificial Sequence: Synthetic oligonucleotide
cggagactcaattgagtctccg

SEQ ID NO: 11086 - DNA, 22 bp, Artificial Sequence
  Description of Artificial Sequence: Synthetic oligonucleotide
ctgcgactcaattgagtcgcag

SEQ ID NO: 11087 - DNA, 22 bp, Artificial Sequence
  Description of Artificial Sequence: Synthetic oligonucleotide
cggtgactcaattgagtcaccg

SEQ ID NO: 11088 - DNA, 22 bp, Artificial Sequence
  Description of Artificial Sequence: Synthetic oligonucleotide
cacggactcaattgagtccgtg

SEQ ID NO: 11089 - DNA, 22 bp, Artificial Sequence
  Description of Artificial Sequence: Synthetic oligonucleotide
cccagactcaattgagtctggg

SEQ ID NO: 11090 - DNA, 22 bp, Artificial Sequence
  Description of Artificial Sequence: Synthetic oligonucleotide
ctcggactcaattgagtccgag

SEQ ID NO: 11091 - DNA, 22 bp, Artificial Sequence
  Description of Artificial Sequence: Synthetic oligonucleotide
ccctgactcaattgagtcaggg

SEQ ID NO: 11092 - DNA, 22 bp, Artificial Sequence
  Description of Artificial Sequence: Synthetic oligonucleotide
ccacgactcaattgagtcgtgg

SEQ ID NO: 11093 - DNA, 22 bp, Artificial Sequence
  Description of Artificial Sequence: Synthetic oligonucleotide
agccgactcaattgagtcggct

SEQ ID NO: 11094 - DNA, 22 bp, Artificial Sequence
  Description of Artificial Sequence: Synthetic oligonucleotide
tgccgactcaattgagtcggca

SEQ ID NO: 11095 - DNA, 22 bp, Artificial Sequence
  Description of Artificial Sequence: Synthetic oligonucleotide
gcgagactcaattgagtctcgc

SEQ ID NO: 11096 - DNA, 22 bp, Artificial Sequence
  Description of Artificial Sequence: Synthetic oligonucleotide
gcgtgactcaattgagtcacgc

SEQ ID NO: 11097 - DNA, 22 bp, Artificial Sequence
  Description of Artificial Sequence: Synthetic oligonucleotide
gcaggactcaattgagtcctgc

SEQ ID NO: 11098 - DNA, 22 bp, Artificial Sequence
  Description of Artificial Sequence: Synthetic oligonucleotide
gctggactcaattgagtccagc

SEQ ID NO: 11099 - DNA, 22 bp, Artificial Sequence
  Description of Artificial Sequence: Synthetic oligonucleotide
cgaggactcaattgagtcctcg

SEQ ID NO: 11100 - DNA, 22 bp, Artificial Sequence
  Description of Artificial Sequence: Synthetic oligonucleotide
cgtggactcaattgagtccacg

SEQ ID NO: 11101 - DNA, 22 bp, Artificial Sequence
  Description of Artificial Sequence: Synthetic oligonucleotide
caccgactcaattgagtcggtg

SEQ ID NO: 11102 - DNA, 22 bp, Artificial Sequence
  Description of Artificial Sequence: Synthetic oligonucleotide
ctccgactcaattgagtcggag

SEQ ID NO: 11103 - DNA, 22 bp, Artificial Sequence
  Description of Artificial Sequence: Synthetic oligonucleotide
gcgggactcaattgagtcccgc

SEQ ID NO: 11104 - DNA, 22 bp, Artificial Sequence
  Description of Artificial Sequence: Synthetic oligonucleotide
gagggactcaattgagtccctc

SEQ ID NO: 11105 - DNA, 22 bp, Artificial Sequence
  Description of Artificial Sequence: Synthetic oligonucleotide
gtgggactcaattgagtcccac

SEQ ID NO: 11106 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactctatagagtcnnnn

SEQ ID NO: 11107 - DNA, 22 bp, Artificial Sequence
  Description of Artificial Sequence: Synthetic oligonucleotide
ggcggactctatagagtccgcc

SEQ ID NO: 11108 - DNA, 22 bp, Artificial Sequence
  Description of Artificial Sequence: Synthetic oligonucleotide
agcggactctatagagtccgct

SEQ ID NO: 11109 - DNA, 22 bp, Artificial Sequence
  Description of Artificial Sequence: Synthetic oligonucleotide
gacggactctatagagtccgtc

SEQ ID NO: 11110 - DNA, 22 bp, Artificial Sequence
  Description of Artificial Sequence: Synthetic oligonucleotide
ggaggactctatagagtcctcc

SEQ ID NO: 11111 - DNA, 22 bp, Artificial Sequence
  Description of Artificial Sequence: Synthetic oligonucleotide
ggcagactctatagagtctgcc

SEQ ID NO: 11112 - DNA, 22 bp, Artificial Sequence
  Description of Artificial Sequence: Synthetic oligonucleotide
tgcggactctatagagtccgca

SEQ ID NO: 11113 - DNA, 22 bp, Artificial Sequence
  Description of Artificial Sequence: Synthetic oligonucleotide
gtcggactctatagagtccgac

SEQ ID NO: 11114 - DNA, 22 bp, Artificial Sequence
  Description of Artificial Sequence: Synthetic oligonucleotide
ggtggactctatagagtccacc

SEQ ID NO: 11115 - DNA, 22 bp, Artificial Sequence
  Description of Artificial Sequence: Synthetic oligonucleotide
ggctgactctatagagtcagcc

SEQ ID NO: 11116 - DNA, 22 bp, Artificial Sequence
  Description of Artificial Sequence: Synthetic oligonucleotide
gcccgactctatagagtcgggc

SEQ ID NO: 11117 - DNA, 22 bp, Artificial Sequence
  Description of Artificial Sequence: Synthetic oligonucleotide
acccgactctatagagtcgggt

SEQ ID NO: 11118 - DNA, 22 bp, Artificial Sequence
  Description of Artificial Sequence: Synthetic oligonucleotide
gaccgactctatagagtcggtc

SEQ ID NO: 11119 - DNA, 22 bp, Artificial Sequence
  Description of Artificial Sequence: Synthetic oligonucleotide
gcacgactctatagagtcgtgc

SEQ ID NO: 11120 - DNA, 22 bp, Artificial Sequence
  Description of Artificial Sequence: Synthetic oligonucleotide
gccagactctatagagtctggc

SEQ ID NO: 11121 - DNA, 22 bp, Artificial Sequence
  Description of Artificial Sequence: Synthetic oligonucleotide
tcccgactctatagagtcggga

SEQ ID NO: 11122 - DNA, 22 bp, Artificial Sequence
  Description of Artificial Sequence: Synthetic oligonucleotide
gtccgactctatagagtcggac

SEQ ID NO: 11123 - DNA, 22 bp, Artificial Sequence
  Description of Artificial Sequence: Synthetic oligonucleotide
gcctgactctatagagtcaggc

SEQ ID NO: 11124 - DNA, 22 bp, Artificial Sequence
  Description of Artificial Sequence: Synthetic oligonucleotide
gggcgactctatagagtcgccc

SEQ ID NO: 11125 - DNA, 22 bp, Artificial Sequence
  Description of Artificial Sequence: Synthetic oligonucleotide
aggcgactctatagagtcgcct

SEQ ID NO: 11126 - DNA, 22 bp, Artificial Sequence
  Description of Artificial Sequence: Synthetic oligonucleotide
gagcgactctatagagtcgctc

SEQ ID NO: 11127 - DNA, 22 bp, Artificial Sequence
  Description of Artificial Sequence: Synthetic oligonucleotide
ggacgactctatagagtcgtcc

SEQ ID NO: 11128 - DNA, 22 bp, Artificial Sequence
  Description of Artificial Sequence: Synthetic oligonucleotide
gggagactctatagagtctccc

SEQ ID NO: 11129 - DNA, 22 bp, Artificial Sequence
  Description of Artificial Sequence: Synthetic oligonucleotide
tggcgactctatagagtcgcca

SEQ ID NO: 11130 - DNA, 22 bp, Artificial Sequence
  Description of Artificial Sequence: Synthetic oligonucleotide
gtgcgactctatagagtcgcac

SEQ ID NO: 11131 - DNA, 22 bp, Artificial Sequence
  Description of Artificial Sequence: Synthetic oligonucleotide
gggtgactctatagagtcaccc

SEQ ID NO: 11132 - DNA, 22 bp, Artificial Sequence
  Description of Artificial Sequence: Synthetic oligonucleotide
acgggactctatagagtcccgt

SEQ ID NO: 11133 - DNA, 22 bp, Artificial Sequence
  Description of Artificial Sequence: Synthetic oligonucleotide
cagggactctatagagtccctg

SEQ ID NO: 11134 - DNA, 22 bp, Artificial Sequence
  Description of Artificial Sequence: Synthetic oligonucleotide
ccaggactctatagagtcctgg

SEQ ID NO: 11135 - DNA, 22 bp, Artificial Sequence
  Description of Artificial Sequence: Synthetic oligonucleotide
ccgagactctatagagtctcgg

SEQ ID NO: 11136 - DNA, 22 bp, Artificial Sequence
  Description of Artificial Sequence: Synthetic oligonucleotide
tcgggactctatagagtcccga

SEQ ID NO: 11137 - DNA, 22 bp, Artificial Sequence
  Description of Artificial Sequence: Synthetic oligonucleotide
ctgggactctatagagtcccag

SEQ ID NO: 11138 - DNA, 22 bp, Artificial Sequence
  Description of Artificial Sequence: Synthetic oligonucleotide
cctggactctatagagtccagg

SEQ ID NO: 11139 - DNA, 22 bp, Artificial Sequence
  Description of Artificial Sequence: Synthetic oligonucleotide
ccgtgactctatagagtcacgg

SEQ ID NO: 11140 - DNA, 22 bp, Artificial Sequence
  Description of Artificial Sequence: Synthetic oligonucleotide
cggcgactctatagagtcgccg

SEQ ID NO: 11141 - DNA, 22 bp, Artificial Sequence
  Description of Artificial Sequence: Synthetic oligonucleotide
cagcgactctatagagtcgctg

SEQ ID NO: 11142 - DNA, 22 bp, Artificial Sequence
  Description of Artificial Sequence: Synthetic oligonucleotide
cgacgactctatagagtcgtcg

SEQ ID NO: 11143 - DNA, 22 bp, Artificial Sequence
  Description of Artificial Sequence: Synthetic oligonucleotide
cggagactctatagagtctccg

SEQ ID NO: 11144 - DNA, 22 bp, Artificial Sequence
  Description of Artificial Sequence: Synthetic oligonucleotide
ctgcgactctatagagtcgcag

SEQ ID NO: 11145 - DNA, 22 bp, Artificial Sequence
  Description of Artificial Sequence: Synthetic oligonucleotide
cggtgactctatagagtcaccg

SEQ ID NO: 11146 - DNA, 22 bp, Artificial Sequence
  Description of Artificial Sequence: Synthetic oligonucleotide
cacggactctatagagtccgtg

SEQ ID NO: 11147 - DNA, 22 bp, Artificial Sequence
  Description of Artificial Sequence: Synthetic oligonucleotide
cccagactctatagagtctggg

SEQ ID NO: 11148 - DNA, 22 bp, Artificial Sequence
  Description of Artificial Sequence: Synthetic oligonucleotide
ctcggactctatagagtccgag

SEQ ID NO: 11149 - DNA, 22 bp, Artificial Sequence
  Description of Artificial Sequence: Synthetic oligonucleotide
ccctgactctatagagtcaggg

SEQ ID NO: 11150 - DNA, 22 bp, Artificial Sequence
  Description of Artificial Sequence: Synthetic oligonucleotide
ccacgactctatagagtcgtgg

SEQ ID NO: 11151 - DNA, 22 bp, Artificial Sequence
  Description of Artificial Sequence: Synthetic oligonucleotide
agccgactctatagagtcggct

SEQ ID NO: 11152 - DNA, 22 bp, Artificial Sequence
  Description of Artificial Sequence: Synthetic oligonucleotide
tgccgactctatagagtcggca

SEQ ID NO: 11153 - DNA, 22 bp, Artificial Sequence
  Description of Artificial Sequence: Synthetic oligonucleotide
gcgagactctatagagtctcgc

SEQ ID NO: 11154 - DNA, 22 bp, Artificial Sequence
  Description of Artificial Sequence: Synthetic oligonucleotide
gcgtgactctatagagtcacgc

SEQ ID NO: 11155 - DNA, 22 bp, Artificial Sequence
  Description of Artificial Sequence: Synthetic oligonucleotide
gcaggactctatagagtcctgc

SEQ ID NO: 11156 - DNA, 22 bp, Artificial Sequence
  Description of Artificial Sequence: Synthetic oligonucleotide
gctggactctatagagtccagc

SEQ ID NO: 11157 - DNA, 22 bp, Artificial Sequence
  Description of Artificial Sequence: Synthetic oligonucleotide
cgaggactctatagagtcctcg

SEQ ID NO: 11158 - DNA, 22 bp, Artificial Sequence
  Description of Artificial Sequence: Synthetic oligonucleotide
cgtggactctatagagtccacg

SEQ ID NO: 11159 - DNA, 22 bp, Artificial Sequence
  Description of Artificial Sequence: Synthetic oligonucleotide
caccgactctatagagtcggtg

SEQ ID NO: 11160 - DNA, 22 bp, Artificial Sequence
  Description of Artificial Sequence: Synthetic oligonucleotide
ctccgactctatagagtcggag

SEQ ID NO: 11161 - DNA, 22 bp, Artificial Sequence
  Description of Artificial Sequence: Synthetic oligonucleotide
gcgggactctatagagtcccgc

SEQ ID NO: 11162 - DNA, 22 bp, Artificial Sequence
  Description of Artificial Sequence: Synthetic oligonucleotide
gagggactctatagagtccctc

SEQ ID NO: 11163 - DNA, 22 bp, Artificial Sequence
  Description of Artificial Sequence: Synthetic oligonucleotide
gtgggactctatagagtcccac

SEQ ID NO: 11164 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcatatgagtcnnnn

SEQ ID NO: 11165 - DNA, 22 bp, Artificial Sequence
  Description of Artificial Sequence: Synthetic oligonucleotide
ggcggactcatatgagtccgcc

SEQ ID NO: 11166 - DNA, 22 bp, Artificial Sequence
  Description of Artificial Sequence: Synthetic oligonucleotide
agcggactcatatgagtccgct

SEQ ID NO: 11167 - DNA, 22 bp, Artificial Sequence
  Description of Artificial Sequence: Synthetic oligonucleotide
gacggactcatatgagtccgtc

SEQ ID NO: 11168 - DNA, 22 bp, Artificial Sequence
  Description of Artificial Sequence: Synthetic oligonucleotide
ggaggactcatatgagtcctcc

SEQ ID NO: 11169 - DNA, 22 bp, Artificial Sequence
  Description of Artificial Sequence: Synthetic oligonucleotide
ggcagactcatatgagtctgcc

SEQ ID NO: 11170 - DNA, 22 bp, Artificial Sequence
  Description of Artificial Sequence: Synthetic oligonucleotide
tgcggactcatatgagtccgca

SEQ ID NO: 11171 - DNA, 22 bp, Artificial Sequence
  Description of Artificial Sequence: Synthetic oligonucleotide
gtcggactcatatgagtccgac

SEQ ID NO: 11172 - DNA, 22 bp, Artificial Sequence
  Description of Artificial Sequence: Synthetic oligonucleotide
ggtggactcatatgagtccacc

SEQ ID NO: 11173 - DNA, 22 bp, Artificial Sequence
  Description of Artificial Sequence: Synthetic oligonucleotide
ggctgactcatatgagtcagcc

SEQ ID NO: 11174 - DNA, 22 bp, Artificial Sequence
  Description of Artificial Sequence: Synthetic oligonucleotide
gcccgactcatatgagtcgggc

SEQ ID NO: 11175 - DNA, 22 bp, Artificial Sequence
  Description of Artificial Sequence: Synthetic oligonucleotide
acccgactcatatgagtcgggt

SEQ ID NO: 11176 - DNA, 22 bp, Artificial Sequence
  Description of Artificial Sequence: Synthetic oligonucleotide
gaccgactcatatgagtcggtc

SEQ ID NO: 11177 - DNA, 22 bp, Artificial Sequence
  Description of Artificial Sequence: Synthetic oligonucleotide
gcacgactcatatgagtcgtgc

SEQ ID NO: 11178 - DNA, 22 bp, Artificial Sequence
  Description of Artificial Sequence: Synthetic oligonucleotide
gccagactcatatgagtctggc

SEQ ID NO: 11179 - DNA, 22 bp, Artificial Sequence
  Description of Artificial Sequence: Synthetic oligonucleotide
tcccgactcatatgagtcggga

SEQ ID NO: 11180 - DNA, 22 bp, Artificial Sequence
  Description of Artificial Sequence: Synthetic oligonucleotide
gtccgactcatatgagtcggac

SEQ ID NO: 11181 - DNA, 22 bp, Artificial Sequence
  Description of Artificial Sequence: Synthetic oligonucleotide
gcctgactcatatgagtcaggc

SEQ ID NO: 11182 - DNA, 22 bp, Artificial Sequence
  Description of Artificial Sequence: Synthetic oligonucleotide
gggcgactcatatgagtcgccc

SEQ ID NO: 11183 - DNA, 22 bp, Artificial Sequence
  Description of Artificial Sequence: Synthetic oligonucleotide
aggcgactcatatgagtcgcct

SEQ ID NO: 11184 - DNA, 22 bp, Artificial Sequence
  Description of Artificial Sequence: Synthetic oligonucleotide
gagcgactcatatgagtcgctc

SEQ ID NO: 11185 - DNA, 22 bp, Artificial Sequence
  Description of Artificial Sequence: Synthetic oligonucleotide
ggacgactcatatgagtcgtcc

SEQ ID NO: 11186 - DNA, 22 bp, Artificial Sequence
  Description of Artificial Sequence: Synthetic oligonucleotide
gggagactcatatgagtctccc

SEQ ID NO: 11187 - DNA, 22 bp, Artificial Sequence
  Description of Artificial Sequence: Synthetic oligonucleotide
tggcgactcatatgagtcgcca

SEQ ID NO: 11188 - DNA, 22 bp, Artificial Sequence
  Description of Artificial Sequence: Synthetic oligonucleotide
gtgcgactcatatgagtcgcac

SEQ ID NO: 11189 - DNA, 22 bp, Artificial Sequence
  Description of Artificial Sequence: Synthetic oligonucleotide
gggtgactcatatgagtcaccc

SEQ ID NO: 11190 - DNA, 22 bp, Artificial Sequence
  Description of Artificial Sequence: Synthetic oligonucleotide
acgggactcatatgagtcccgt

SEQ ID NO: 11191 - DNA, 22 bp, Artificial Sequence
  Description of Artificial Sequence: Synthetic oligonucleotide
cagggactcatatgagtccctg

SEQ ID NO: 11192 - DNA, 22 bp, Artificial Sequence
  Description of Artificial Sequence: Synthetic oligonucleotide
ccaggactcatatgagtcctgg

SEQ ID NO: 11193 - DNA, 22 bp, Artificial Sequence
  Description of Artificial Sequence: Synthetic oligonucleotide
ccgagactcatatgagtctcgg

SEQ ID NO: 11194 - DNA, 22 bp, Artificial Sequence
  Description of Artificial Sequence: Synthetic oligonucleotide
tcgggactcatatgagtcccga

SEQ ID NO: 11195 - DNA, 22 bp, Artificial Sequence
  Description of Artificial Sequence: Synthetic oligonucleotide
ctgggactcatatgagtcccag

SEQ ID NO: 11196 - DNA, 22 bp, Artificial Sequence
  Description of Artificial Sequence: Synthetic oligonucleotide
cctggactcatatgagtccagg

SEQ ID NO: 11197 - DNA, 22 bp, Artificial Sequence
  Description of Artificial Sequence: Synthetic oligonucleotide
ccgtgactcatatgagtcacgg

SEQ ID NO: 11198 - DNA, 22 bp, Artificial Sequence
  Description of Artificial Sequence: Synthetic oligonucleotide
cggcgactcatatgagtcgccg

SEQ ID NO: 11199 - DNA, 22 bp, Artificial Sequence
  Description of Artificial Sequence: Synthetic oligonucleotide
cagcgactcatatgagtcgctg

SEQ ID NO: 11200 - DNA, 22 bp, Artificial Sequence
  Description of Artificial Sequence: Synthetic oligonucleotide
cgacgactcatatgagtcgtcg

SEQ ID NO: 11201 - DNA, 22 bp, Artificial Sequence
  Description of Artificial Sequence: Synthetic oligonucleotide
cggagactcatatgagtctccg

SEQ ID NO: 11202 - DNA, 22 bp, Artificial Sequence
  Description of Artificial Sequence: Synthetic oligonucleotide
ctgcgactcatatgagtcgcag

SEQ ID NO: 11203 - DNA, 22 bp, Artificial Sequence
  Description of Artificial Sequence: Synthetic oligonucleotide
cggtgactcatatgagtcaccg

SEQ ID NO: 11204 - DNA, 22 bp, Artificial Sequence
  Description of Artificial Sequence: Synthetic oligonucleotide
cacggactcatatgagtccgtg

SEQ ID NO: 11205 - DNA, 22 bp, Artificial Sequence
  Description of Artificial Sequence: Synthetic oligonucleotide
cccagactcatatgagtctggg

SEQ ID NO: 11206 - DNA, 22 bp, Artificial Sequence
  Description of Artificial Sequence: Synthetic oligonucleotide
ctcggactcatatgagtccgag

SEQ ID NO: 11207 - DNA, 22 bp, Artificial Sequence
  Description of Artificial Sequence: Synthetic oligonucleotide
ccctgactcatatgagtcaggg

SEQ ID NO: 11208 - DNA, 22 bp, Artificial Sequence
  Description of Artificial Sequence: Synthetic oligonucleotide
ccacgactcatatgagtcgtgg

SEQ ID NO: 11209 - DNA, 22 bp, Artificial Sequence
  Description of Artificial Sequence: Synthetic oligonucleotide
agccgactcatatgagtcggct

SEQ ID NO: 11210 - DNA, 22 bp, Artificial Sequence
  Description of Artificial Sequence: Synthetic oligonucleotide
tgccgactcatatgagtcggca

SEQ ID NO: 11211 - DNA, 22 bp, Artificial Sequence
  Description of Artificial Sequence: Synthetic oligonucleotide
gcgagactcatatgagtctcgc

SEQ ID NO: 11212 - DNA, 22 bp, Artificial Sequence
  Description of Artificial Sequence: Synthetic oligonucleotide
gcgtgactcatatgagtcacgc

SEQ ID NO: 11213 - DNA, 22 bp, Artificial Sequence
  Description of Artificial Sequence: Synthetic oligonucleotide
gcaggactcatatgagtcctgc

SEQ ID NO: 11214 - DNA, 22 bp, Artificial Sequence
  Description of Artificial Sequence: Synthetic oligonucleotide
gctggactcatatgagtccagc

SEQ ID NO: 11215 - DNA, 22 bp, Artificial Sequence
  Description of Artificial Sequence: Synthetic oligonucleotide
cgaggactcatatgagtcctcg

SEQ ID NO: 11216 - DNA, 22 bp, Artificial Sequence
  Description of Artificial Sequence: Synthetic oligonucleotide
cgtggactcatatgagtccacg

SEQ ID NO: 11217 - DNA, 22 bp, Artificial Sequence
  Description of Artificial Sequence: Synthetic oligonucleotide
caccgactcatatgagtcggtg

SEQ ID NO: 11218 - DNA, 22 bp, Artificial Sequence
  Description of Artificial Sequence: Synthetic oligonucleotide
ctccgactcatatgagtcggag

SEQ ID NO: 11219 - DNA, 22 bp, Artificial Sequence
  Description of Artificial Sequence: Synthetic oligonucleotide
gcgggactcatatgagtcccgc

SEQ ID NO: 11220 - DNA, 22 bp, Artificial Sequence
  Description of Artificial Sequence: Synthetic oligonucleotide
gagggactcatatgagtccctc

SEQ ID NO: 11221 - DNA, 22 bp, Artificial Sequence
  Description of Artificial Sequence: Synthetic oligonucleotide
gtgggactcatatgagtcccac

SEQ ID NO: 11222 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcttaagagtcnnnn

SEQ ID NO: 11223 - DNA, 22 bp, Artificial Sequence
  Description of Artificial Sequence: Synthetic oligonucleotide
ggcggactcttaagagtccgcc

SEQ ID NO: 11224 - DNA, 22 bp, Artificial Sequence
  Description of Artificial Sequence: Synthetic oligonucleotide
agcggactcttaagagtccgct

SEQ ID NO: 11225 - DNA, 22 bp, Artificial Sequence
  Description of Artificial Sequence: Synthetic oligonucleotide
gacggactcttaagagtccgtc

SEQ ID NO: 11226 - DNA, 22 bp, Artificial Sequence
  Description of Artificial Sequence: Synthetic oligonucleotide
ggaggactcttaagagtcctcc

SEQ ID NO: 11227 - DNA, 22 bp, Artificial Sequence
  Description of Artificial Sequence: Synthetic oligonucleotide
ggcagactcttaagagtctgcc

SEQ ID NO: 11228 - DNA, 22 bp, Artificial Sequence
  Description of Artificial Sequence: Synthetic oligonucleotide
tgcggactcttaagagtccgca

SEQ ID NO: 11229 - DNA, 22 bp, Artificial Sequence
  Description of Artificial Sequence: Synthetic oligonucleotide
gtcggactcttaagagtccgac

SEQ ID NO: 11230 - DNA, 22 bp, Artificial Sequence
  Description of Artificial Sequence: Synthetic oligonucleotide
ggtggactcttaagagtccacc

SEQ ID NO: 11231 - DNA, 22 bp, Artificial Sequence
  Description of Artificial Sequence: Synthetic oligonucleotide
ggctgactcttaagagtcagcc

SEQ ID NO: 11232 - DNA, 22 bp, Artificial Sequence
  Description of Artificial Sequence: Synthetic oligonucleotide
gcccgactcttaagagtcgggc

SEQ ID NO: 11233 - DNA, 22 bp, Artificial Sequence
  Description of Artificial Sequence: Synthetic oligonucleotide
acccgactcttaagagtcgggt

SEQ ID NO: 11234 - DNA, 22 bp, Artificial Sequence
  Description of Artificial Sequence: Synthetic oligonucleotide
gaccgactcttaagagtcggtc

SEQ ID NO: 11235 - DNA, 22 bp, Artificial Sequence
  Description of Artificial Sequence: Synthetic oligonucleotide
gcacgactcttaagagtcgtgc

SEQ ID NO: 11236 - DNA, 22 bp, Artificial Sequence
  Description of Artificial Sequence: Synthetic oligonucleotide
gccagactcttaagagtctggc

SEQ ID NO: 11237 - DNA, 22 bp, Artificial Sequence
  Description of Artificial Sequence: Synthetic oligonucleotide
tcccgactcttaagagtcggga

SEQ ID NO: 11238 - DNA, 22 bp, Artificial Sequence
  Description of Artificial Sequence: Synthetic oligonucleotide
gtccgactcttaagagtcggac

SEQ ID NO: 11239 - DNA, 22 bp, Artificial Sequence
  Description of Artificial Sequence: Synthetic oligonucleotide
gcctgactcttaagagtcaggc

SEQ ID NO: 11240 - DNA, 22 bp, Artificial Sequence
  Description of Artificial Sequence: Synthetic oligonucleotide
gggcgactcttaagagtcgccc

SEQ ID NO: 11241 - DNA, 22 bp, Artificial Sequence
  Description of Artificial Sequence: Synthetic oligonucleotide
aggcgactcttaagagtcgcct

SEQ ID NO: 11242 - DNA, 22 bp, Artificial Sequence
  Description of Artificial Sequence: Synthetic oligonucleotide
gagcgactcttaagagtcgctc

SEQ ID NO: 11243 - DNA, 22 bp, Artificial Sequence
  Description of Artificial Sequence: Synthetic oligonucleotide
ggacgactcttaagagtcgtcc

SEQ ID NO: 11244 - DNA, 22 bp, Artificial Sequence
  Description of Artificial Sequence: Synthetic oligonucleotide
gggagactcttaagagtctccc

SEQ ID NO: 11245 - DNA, 22 bp, Artificial Sequence
  Description of Artificial Sequence: Synthetic oligonucleotide
tggcgactcttaagagtcgcca

SEQ ID NO: 11246 - DNA, 22 bp, Artificial Sequence
  Description of Artificial Sequence: Synthetic oligonucleotide
gtgcgactcttaagagtcgcac

SEQ ID NO: 11247 - DNA, 22 bp, Artificial Sequence
  Description of Artificial Sequence: Synthetic oligonucleotide
gggtgactcttaagagtcaccc

SEQ ID NO: 11248 - DNA, 22 bp, Artificial Sequence
  Description of Artificial Sequence: Synthetic oligonucleotide
acgggactcttaagagtcccgt

SEQ ID NO: 11249 - DNA, 22 bp, Artificial Sequence
  Description of Artificial Sequence: Synthetic oligonucleotide
cagggactcttaagagtccctg

SEQ ID NO: 11250 - DNA, 22 bp, Artificial Sequence
  Description of Artificial Sequence: Synthetic oligonucleotide
ccaggactcttaagagtcctgg

SEQ ID NO: 11251 - DNA, 22 bp, Artificial Sequence
  Description of Artificial Sequence: Synthetic oligonucleotide
ccgagactcttaagagtctcgg

SEQ ID NO: 11252 - DNA, 22 bp, Artificial Sequence
  Description of Artificial Sequence: Synthetic oligonucleotide
tcgggactcttaagagtcccga

SEQ ID NO: 11253 - DNA, 22 bp, Artificial Sequence
  Description of Artificial Sequence: Synthetic oligonucleotide
ctgggactcttaagagtcccag

SEQ ID NO: 11254 - DNA, 22 bp, Artificial Sequence
  Description of Artificial Sequence: Synthetic oligonucleotide
cctggactcttaagagtccagg

SEQ ID NO: 11255 - DNA, 22 bp, Artificial Sequence
  Description of Artificial Sequence: Synthetic oligonucleotide
ccgtgactcttaagagtcacgg

SEQ ID NO: 11256 - DNA, 22 bp, Artificial Sequence
  Description of Artificial Sequence: Synthetic oligonucleotide
cggcgactcttaagagtcgccg

SEQ ID NO: 11257 - DNA, 22 bp, Artificial Sequence
  Description of Artificial Sequence: Synthetic oligonucleotide
cagcgactcttaagagtcgctg

SEQ ID NO: 11258 - DNA, 22 bp, Artificial Sequence
  Description of Artificial Sequence: Synthetic oligonucleotide
cgacgactcttaagagtcgtcg

SEQ ID NO: 11259 - DNA, 22 bp, Artificial Sequence
  Description of Artificial Sequence: Synthetic oligonucleotide
cggagactcttaagagtctccg

SEQ ID NO: 11260 - DNA, 22 bp, Artificial Sequence
  Description of Artificial Sequence: Synthetic oligonucleotide
ctgcgactcttaagagtcgcag

SEQ ID NO: 11261 - DNA, 22 bp, Artificial Sequence
  Description of Artificial Sequence: Synthetic oligonucleotide
cggtgactcttaagagtcaccg

SEQ ID NO: 11262 - DNA, 22 bp, Artificial Sequence
  Description of Artificial Sequence: Synthetic oligonucleotide
cacggactcttaagagtccgtg

SEQ ID NO: 11263 - DNA, 22 bp, Artificial Sequence
  Description of Artificial Sequence: Synthetic oligonucleotide
cccagactcttaagagtctggg

SEQ ID NO: 11264 - DNA, 22 bp, Artificial Sequence
  Description of Artificial Sequence: Synthetic oligonucleotide
ctcggactcttaagagtccgag

SEQ ID NO: 11265 - DNA, 22 bp, Artificial Sequence
  Description of Artificial Sequence: Synthetic oligonucleotide
ccctgactcttaagagtcaggg

SEQ ID NO: 11266 - DNA, 22 bp, Artificial Sequence
  Description of Artificial Sequence: Synthetic oligonucleotide
ccacgactcttaagagtcgtgg

SEQ ID NO: 11267 - DNA, 22 bp, Artificial Sequence
  Description of Artificial Sequence: Synthetic oligonucleotide
agccgactcttaagagtcggct

SEQ ID NO: 11268 - DNA, 22 bp, Artificial Sequence
  Description of Artificial Sequence: Synthetic oligonucleotide
tgccgactcttaagagtcggca

SEQ ID NO: 11269 - DNA, 22 bp, Artificial Sequence
  Description of Artificial Sequence: Synthetic oligonucleotide
gcgagactcttaagagtctcgc

SEQ ID NO: 11270 - DNA, 22 bp, Artificial Sequence
  Description of Artificial Sequence: Synthetic oligonucleotide
gcgtgactcttaagagtcacgc

SEQ ID NO: 11271 - DNA, 22 bp, Artificial Sequence
  Description of Artificial Sequence: Synthetic oligonucleotide
gcaggactcttaagagtcctgc

SEQ ID NO: 11272 - DNA, 22 bp, Artificial Sequence
  Description of Artificial Sequence: Synthetic oligonucleotide
gctggactcttaagagtccagc

SEQ ID NO: 11273 - DNA, 22 bp, Artificial Sequence
  Description of Artificial Sequence: Synthetic oligonucleotide
cgaggactcttaagagtcctcg

SEQ ID NO: 11274 - DNA, 22 bp, Artificial Sequence
  Description of Artificial Sequence: Synthetic oligonucleotide
cgtggactcttaagagtccacg

SEQ ID NO: 11275 - DNA, 22 bp, Artificial Sequence
  Description of Artificial Sequence: Synthetic oligonucleotide
caccgactcttaagagtcggtg

SEQ ID NO: 11276 - DNA, 22 bp, Artificial Sequence
  Description of Artificial Sequence: Synthetic oligonucleotide
ctccgactcttaagagtcggag

SEQ ID NO: 11277 - DNA, 22 bp, Artificial Sequence
  Description of Artificial Sequence: Synthetic oligonucleotide
gcgggactcttaagagtcccgc

SEQ ID NO: 11278 - DNA, 22 bp, Artificial Sequence
  Description of Artificial Sequence: Synthetic oligonucleotide
gagggactcttaagagtccctc

SEQ ID NO: 11279 - DNA, 22 bp, Artificial Sequence
  Description of Artificial Sequence: Synthetic oligonucleotide
gtgggactcttaagagtcccac

SEQ ID NO: 11280 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactccgcggagtcnnnn

SEQ ID NO: 11281 - DNA, 21 bp, Artificial Sequence
  Description of Artificial Sequence: Synthetic oligonucleotide
gcggactccgcggagtccgcc

SEQ ID NO: 11282 - DNA, 21 bp, Artificial Sequence
  Description of Artificial Sequence: Synthetic oligonucleotide
gcggactccgcggagtccgct

SEQ ID NO: 11283 - DNA, 21 bp, Artificial Sequence
  Description of Artificial Sequence: Synthetic oligonucleotide
acggactccgcggagtccgtc

SEQ ID NO: 11284 - DNA, 21 bp, Artificial Sequence
  Description of Artificial Sequence: Synthetic oligonucleotide
gaggactccgcggagtcctcc

SEQ ID NO: 11285 - DNA, 21 bp, Artificial Sequence
  Description of Artificial Sequence: Synthetic oligonucleotide
gcagactccgcggagtctgcc

SEQ ID NO: 11286 - DNA, 21 bp, Artificial Sequence
  Description of Artificial Sequence: Synthetic oligonucleotide
gcggactccgcggagtccgca

SEQ ID NO: 11287 - DNA, 21 bp, Artificial Sequence
  Description of Artificial Sequence: Synthetic oligonucleotide
tcggactccgcggagtccgac

SEQ ID NO: 11288 - DNA, 21 bp, Artificial Sequence
  Description of Artificial Sequence: Synthetic oligonucleotide
gtggactccgcggagtccacc

SEQ ID NO: 11289 - DNA, 21 bp, Artificial Sequence
  Description of Artificial Sequence: Synthetic oligonucleotide
gctgactccgcggagtcagcc

SEQ ID NO: 11290 - DNA, 21 bp, Artificial Sequence
  Description of Artificial Sequence: Synthetic oligonucleotide
cccgactccgcggagtcgggc

SEQ ID NO: 11291 - DNA, 21 bp, Artificial Sequence
  Description of Artificial Sequence: Synthetic oligonucleotide
cccgactccgcggagtcgggt

SEQ ID NO: 11292 - DNA, 21 bp, Artificial Sequence
  Description of Artificial Sequence: Synthetic oligonucleotide
accgactccgcggagtcggtc

SEQ ID NO: 11293 - DNA, 21 bp, Artificial Sequence
  Description of Artificial Sequence: Synthetic oligonucleotide
cacgactccgcggagtcgtgc

SEQ ID NO: 11294 - DNA, 21 bp, Artificial Sequence
  Description of Artificial Sequence: Synthetic oligonucleotide
ccagactccgcggagtctggc

SEQ ID NO: 11295 - DNA, 21 bp, Artificial Sequence
  Description of Artificial Sequence: Synthetic oligonucleotide
cccgactccgcggagtcggga

SEQ ID NO: 11296 - DNA, 21 bp, Artificial Sequence
  Description of Artificial Sequence: Synthetic oligonucleotide
tccgactccgcggagtcggac

SEQ ID NO: 11297 - DNA, 21 bp, Artificial Sequence
  Description of Artificial Sequence: Synthetic oligonucleotide
cctgactccgcggagtcaggc

SEQ ID NO: 11298 - DNA, 21 bp, Artificial Sequence
  Description of Artificial Sequence: Synthetic oligonucleotide
ggcgactccgcggagtcgccc

SEQ ID NO: 11299 - DNA, 21 bp, Artificial Sequence
  Description of Artificial Sequence: Synthetic oligonucleotide
ggcgactccgcggagtcgcct

SEQ ID NO: 11300 - DNA, 21 bp, Artificial Sequence
  Description of Artificial Sequence: Synthetic oligonucleotide
agcgactccgcggagtcgctc

SEQ ID NO: 11301 - DNA, 21 bp, Artificial Sequence
  Description of Artificial Sequence: Synthetic oligonucleotide
gacgactccgcggagtcgtcc

SEQ ID NO: 11302 - DNA, 21 bp, Artificial Sequence
  Description of Artificial Sequence: Synthetic oligonucleotide
ggagactccgcggagtctccc

SEQ ID NO: 11303 - DNA, 21 bp, Artificial Sequence
  Description of Artificial Sequence: Synthetic oligonucleotide
ggcgactccgcggagtcgcca

SEQ ID NO: 11304 - DNA, 21 bp, Artificial Sequence
  Description of Artificial Sequence: Synthetic oligonucleotide
tgcgactccgcggagtcgcac

SEQ ID NO: 11305 - DNA, 21 bp, Artificial Sequence
  Description of Artificial Sequence: Synthetic oligonucleotide
ggtgactccgcggagtcaccc

SEQ ID NO: 11306 - DNA, 21 bp, Artificial Sequence
  Description of Artificial Sequence: Synthetic oligonucleotide
cgggactccgcggagtcccgt

SEQ ID NO: 11307 - DNA, 21 bp, Artificial Sequence
  Description of Artificial Sequence: Synthetic oligonucleotide
agggactccgcggagtccctg

SEQ ID NO: 11308 - DNA, 21 bp, Artificial Sequence
  Description of Artificial Sequence: Synthetic oligonucleotide
caggactccgcggagtcctgg

SEQ ID NO: 11309 - DNA, 21 bp, Artificial Sequence
  Description of Artificial Sequence: Synthetic oligonucleotide
cgagactccgcggagtctcgg

SEQ ID NO: 11310 - DNA, 21 bp, Artificial Sequence
  Description of Artificial Sequence: Synthetic oligonucleotide
cgggactccgcggagtcccga

SEQ ID NO: 11311 - DNA, 21 bp, Artificial Sequence
  Description of Artificial Sequence: Synthetic oligonucleotide
tgggactccgcggagtcccag

SEQ ID NO: 11312 - DNA, 21 bp, Artificial Sequence
  Description of Artificial Sequence: Synthetic oligonucleotide
ctggactccgcggagtccagg

SEQ ID NO: 11313 - DNA, 21 bp, Artificial Sequence
  Description of Artificial Sequence: Synthetic oligonucleotide
cgtgactccgcggagtcacgg

SEQ ID NO: 11314 - DNA, 21 bp, Artificial Sequence
  Description of Artificial Sequence: Synthetic oligonucleotide
ggcgactccgcggagtcgccg

SEQ ID NO: 11315 - DNA, 21 bp, Artificial Sequence
  Description of Artificial Sequence: Synthetic oligonucleotide
agcgactccgcggagtcgctg

SEQ ID NO: 11316 - DNA, 21 bp, Artificial Sequence
  Description of Artificial Sequence: Synthetic oligonucleotide
gacgactccgcggagtcgtcg

SEQ ID NO: 11317 - DNA, 21 bp, Artificial Sequence
  Description of Artificial Sequence: Synthetic oligonucleotide
ggagactccgcggagtctccg

SEQ ID NO: 11318 - DNA, 21 bp, Artificial Sequence
  Description of Artificial Sequence: Synthetic oligonucleotide
tgcgactccgcggagtcgcag

SEQ ID NO: 11319 - DNA, 21 bp, Artificial Sequence
  Description of Artificial Sequence: Synthetic oligonucleotide
ggtgactccgcggagtcaccg

SEQ ID NO: 11320 - DNA, 21 bp, Artificial Sequence
  Description of Artificial Sequence: Synthetic oligonucleotide
acggactccgcggagtccgtg

SEQ ID NO: 11321 - DNA, 21 bp, Artificial Sequence
  Description of Artificial Sequence: Synthetic oligonucleotide
ccagactccgcggagtctggg

SEQ ID NO: 11322 - DNA, 21 bp, Artificial Sequence
  Description of Artificial Sequence: Synthetic oligonucleotide
tcggactccgcggagtccgag

SEQ ID NO: 11323 - DNA, 21 bp, Artificial Sequence
  Description of Artificial Sequence: Synthetic oligonucleotide
cctgactccgcggagtcaggg

SEQ ID NO: 11324 - DNA, 21 bp, Artificial Sequence
  Description of Artificial Sequence: Synthetic oligonucleotide
cacgactccgcggagtcgtgg

SEQ ID NO: 11325 - DNA, 21 bp, Artificial Sequence
  Description of Artificial Sequence: Synthetic oligonucleotide
gccgactccgcggagtcggct

SEQ ID NO: 11326 - DNA, 21 bp, Artificial Sequence
  Description of Artificial Sequence: Synthetic oligonucleotide
gccgactccgcggagtcggca

SEQ ID NO: 11327 - DNA, 21 bp, Artificial Sequence
  Description of Artificial Sequence: Synthetic oligonucleotide
cgagactccgcggagtctcgc

SEQ ID NO: 11328 - DNA, 21 bp, Artificial Sequence
  Description of Artificial Sequence: Synthetic oligonucleotide
cgtgactccgcggagtcacgc

SEQ ID NO: 11329 - DNA, 21 bp, Artificial Sequence
  Description of Artificial Sequence: Synthetic oligonucleotide
caggactccgcggagtcctgc

SEQ ID NO: 11330 - DNA, 21 bp, Artificial Sequence
  Description of Artificial Sequence: Synthetic oligonucleotide
ctggactccgcggagtccagc

SEQ ID NO: 11331 - DNA, 21 bp, Artificial Sequence
  Description of Artificial Sequence: Synthetic oligonucleotide
gaggactccgcggagtcctcg

SEQ ID NO: 11332 - DNA, 21 bp, Artificial Sequence
  Description of Artificial Sequence: Synthetic oligonucleotide
gtggactccgcggagtccacg

SEQ ID NO: 11333 - DNA, 21 bp, Artificial Sequence
  Description of Artificial Sequence: Synthetic oligonucleotide
accgactccgcggagtcggtg

SEQ ID NO: 11334 - DNA, 21 bp, Artificial Sequence
  Description of Artificial Sequence: Synthetic oligonucleotide
tccgactccgcggagtcggag

SEQ ID NO: 11335 - DNA, 21 bp, Artificial Sequence
  Description of Artificial Sequence: Synthetic oligonucleotide
cgggactccgcggagtcccgc

SEQ ID NO: 11336 - DNA, 21 bp, Artificial Sequence
  Description of Artificial Sequence: Synthetic oligonucleotide
agggactccgcggagtccctc

SEQ ID NO: 11337 - DNA, 21 bp, Artificial Sequence
  Description of Artificial Sequence: Synthetic oligonucleotide
tgggactccgcggagtcccac

SEQ ID NO: 11338 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactctgcagagtcnnnn

SEQ ID NO: 11339 - DNA, 21 bp, Artificial Sequence
  Description of Artificial Sequence: Synthetic oligonucleotide
gcggactctgcagagtccgcc

SEQ ID NO: 11340 - DNA, 21 bp, Artificial Sequence
  Description of Artificial Sequence: Synthetic oligonucleotide
gcggactctgcagagtccgct

SEQ ID NO: 11341 - DNA, 21 bp, Artificial Sequence
  Description of Artificial Sequence: Synthetic oligonucleotide
acggactctgcagagtccgtc

SEQ ID NO: 11342 - DNA, 21 bp, Artificial Sequence
  Description of Artificial Sequence: Synthetic oligonucleotide
gaggactctgcagagtcctcc

SEQ ID NO: 11343 - DNA, 21 bp, Artificial Sequence
  Description of Artificial Sequence: Synthetic oligonucleotide
gcagactctgcagagtctgcc

SEQ ID NO: 11344 - DNA, 21 bp, Artificial Sequence
  Description of Artificial Sequence: Synthetic oligonucleotide
gcggactctgcagagtccgca

SEQ ID NO: 11345 - DNA, 21 bp, Artificial Sequence
  Description of Artificial Sequence: Synthetic oligonucleotide
tcggactctgcagagtccgac

SEQ ID NO: 11346 - DNA, 21 bp, Artificial Sequence
  Description of Artificial Sequence: Synthetic oligonucleotide
gtggactctgcagagtccacc

SEQ ID NO: 11347 - DNA, 21 bp, Artificial Sequence
  Description of Artificial Sequence: Synthetic oligonucleotide
gctgactctgcagagtcagcc

SEQ ID NO: 11348 - DNA, 21 bp, Artificial Sequence
  Description of Artificial Sequence: Synthetic oligonucleotide
cccgactctgcagagtcgggc

SEQ ID NO: 11349 - DNA, 21 bp, Artificial Sequence
  Description of Artificial Sequence: Synthetic oligonucleotide
cccgactctgcagagtcgggt

SEQ ID NO: 11350 - DNA, 21 bp, Artificial Sequence
  Description of Artificial Sequence: Synthetic oligonucleotide
accgactctgcagagtcggtc

SEQ ID NO: 11351 - DNA, 21 bp, Artificial Sequence
  Description of Artificial Sequence: Synthetic oligonucleotide
cacgactctgcagagtcgtgc

SEQ ID NO: 11352 - DNA, 21 bp, Artificial Sequence
  Description of Artificial Sequence: Synthetic oligonucleotide
ccagactctgcagagtctggc

SEQ ID NO: 11353 - DNA, 21 bp, Artificial Sequence
  Description of Artificial Sequence: Synthetic oligonucleotide
cccgactctgcagagtcggga

SEQ ID NO: 11354 - DNA, 21 bp, Artificial Sequence
  Description of Artificial Sequence: Synthetic oligonucleotide
tccgactctgcagagtcggac

SEQ ID NO: 11355 - DNA, 21 bp, Artificial Sequence
  Description of Artificial Sequence: Synthetic oligonucleotide
cctgactctgcagagtcaggc

SEQ ID NO: 11356 - DNA, 21 bp, Artificial Sequence
  Description of Artificial Sequence: Synthetic oligonucleotide
ggcgactctgcagagtcgccc

SEQ ID NO: 11357 - DNA, 21 bp, Artificial Sequence
  Description of Artificial Sequence: Synthetic oligonucleotide
ggcgactctgcagagtcgcct

SEQ ID NO: 11358 - DNA, 21 bp, Artificial Sequence
  Description of Artificial Sequence: Synthetic oligonucleotide
agcgactctgcagagtcgctc

SEQ ID NO: 11359 - DNA, 21 bp, Artificial Sequence
  Description of Artificial Sequence: Synthetic oligonucleotide
gacgactctgcagagtcgtcc

SEQ ID NO: 11360 - DNA, 21 bp, Artificial Sequence
  Description of Artificial Sequence: Synthetic oligonucleotide
ggagactctgcagagtctccc

SEQ ID NO: 11361 - DNA, 21 bp, Artificial Sequence
  Description of Artificial Sequence: Synthetic oligonucleotide
ggcgactctgcagagtcgcca

SEQ ID NO: 11362 - DNA, 21 bp, Artificial Sequence
  Description of Artificial Sequence: Synthetic oligonucleotide
tgcgactctgcagagtcgcac

SEQ ID NO: 11363 - DNA, 21 bp, Artificial Sequence
  Description of Artificial Sequence: Synthetic oligonucleotide
ggtgactctgcagagtcaccc

SEQ ID NO: 11364 - DNA, 21 bp, Artificial Sequence
  Description of Artificial Sequence: Synthetic oligonucleotide
cgggactctgcagagtcccgt

SEQ ID NO: 11365 - DNA, 21 bp, Artificial Sequence
  Description of Artificial Sequence: Synthetic oligonucleotide
agggactctgcagagtccctg

SEQ ID NO: 11366 - DNA, 21 bp, Artificial Sequence
  Description of Artificial Sequence: Synthetic oligonucleotide
caggactctgcagagtcctgg

SEQ ID NO: 11367 - DNA, 21 bp, Artificial Sequence
  Description of Artificial Sequence: Synthetic oligonucleotide
cgagactctgcagagtctcgg

SEQ ID NO: 11368 - DNA, 21 bp, Artificial Sequence
  Description of Artificial Sequence: Synthetic oligonucleotide
cgggactctgcagagtcccga

SEQ ID NO: 11369 - DNA, 21 bp, Artificial Sequence
  Description of Artificial Sequence: Synthetic oligonucleotide
tgggactctgcagagtcccag

SEQ ID NO: 11370 - DNA, 21 bp, Artificial Sequence
  Description of Artificial Sequence: Synthetic oligonucleotide
ctggactctgcagagtccagg

SEQ ID NO: 11371 - DNA, 21 bp, Artificial Sequence
  Description of Artificial Sequence: Synthetic oligonucleotide
cgtgactctgcagagtcacgg

SEQ ID NO: 11372 - DNA, 21 bp, Artificial Sequence
  Description of Artificial Sequence: Synthetic oligonucleotide
ggcgactctgcagagtcgccg

SEQ ID NO: 11373 - DNA, 21 bp, Artificial Sequence
  Description of Artificial Sequence: Synthetic oligonucleotide
agcgactctgcagagtcgctg

SEQ ID NO: 11374 - DNA, 21 bp, Artificial Sequence
  Description of Artificial Sequence: Synthetic oligonucleotide
gacgactctgcagagtcgtcg

SEQ ID NO: 11375 - DNA, 21 bp, Artificial Sequence
  Description of Artificial Sequence: Synthetic oligonucleotide
ggagactctgcagagtctccg

SEQ ID NO: 11376 - DNA, 21 bp, Artificial Sequence
  Description of Artificial Sequence: Synthetic oligonucleotide
tgcgactctgcagagtcgcag

SEQ ID NO: 11377 - DNA, 21 bp, Artificial Sequence
  Description of Artificial Sequence: Synthetic oligonucleotide
ggtgactctgcagagtcaccg

SEQ ID NO: 11378 - DNA, 21 bp, Artificial Sequence
  Description of Artificial Sequence: Synthetic oligonucleotide
acggactctgcagagtccgtg

SEQ ID NO: 11379 - DNA, 21 bp, Artificial Sequence
  Description of Artificial Sequence: Synthetic oligonucleotide
ccagactctgcagagtctggg

SEQ ID NO: 11380 - DNA, 21 bp, Artificial Sequence
  Description of Artificial Sequence: Synthetic oligonucleotide
tcggactctgcagagtccgag

SEQ ID NO: 11381 - DNA, 21 bp, Artificial Sequence
  Description of Artificial Sequence: Synthetic oligonucleotide
cctgactctgcagagtcaggg

SEQ ID NO: 11382 - DNA, 21 bp, Artificial Sequence
  Description of Artificial Sequence: Synthetic oligonucleotide
cacgactctgcagagtcgtgg

SEQ ID NO: 11383 - DNA, 21 bp, Artificial Sequence
  Description of Artificial Sequence: Synthetic oligonucleotide
gccgactctgcagagtcggct

SEQ ID NO: 11384 - DNA, 21 bp, Artificial Sequence
  Description of Artificial Sequence: Synthetic oligonucleotide
gccgactctgcagagtcggca

SEQ ID NO: 11385 - DNA, 21 bp, Artificial Sequence
  Description of Artificial Sequence: Synthetic oligonucleotide
cgagactctgcagagtctcgc

SEQ ID NO: 11386 - DNA, 21 bp, Artificial Sequence
  Description of Artificial Sequence: Synthetic oligonucleotide
cgtgactctgcagagtcacgc

SEQ ID NO: 11387 - DNA, 21 bp, Artificial Sequence
  Description of Artificial Sequence: Synthetic oligonucleotide
caggactctgcagagtcctgc

SEQ ID NO: 11388 - DNA, 21 bp, Artificial Sequence
  Description of Artificial Sequence: Synthetic oligonucleotide
ctggactctgcagagtccagc

SEQ ID NO: 11389 - DNA, 21 bp, Artificial Sequence
  Description of Artificial Sequence: Synthetic oligonucleotide
gaggactctgcagagtcctcg

SEQ ID NO: 11390 - DNA, 21 bp, Artificial Sequence
  Description of Artificial Sequence: Synthetic oligonucleotide
gtggactctgcagagtccacg

SEQ ID NO: 11391 - DNA, 21 bp, Artificial Sequence
  Description of Artificial Sequence: Synthetic oligonucleotide
accgactctgcagagtcggtg

SEQ ID NO: 11392 - DNA, 21 bp, Artificial Sequence
  Description of Artificial Sequence: Synthetic oligonucleotide
tccgactctgcagagtcggag

SEQ ID NO: 11393 - DNA, 21 bp, Artificial Sequence
  Description of Artificial Sequence: Synthetic oligonucleotide
cgggactctgcagagtcccgc

SEQ ID NO: 11394 - DNA, 21 bp, Artificial Sequence
  Description of Artificial Sequence: Synthetic oligonucleotide
agggactctgcagagtccctc

SEQ ID NO: 11395 - DNA, 21 bp, Artificial Sequence
  Description of Artificial Sequence: Synthetic oligonucleotide
tgggactctgcagagtcccac

SEQ ID NO: 11396 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcgcgcgagtcnnnn

SEQ ID NO: 11397 - DNA, 21 bp, Artificial Sequence
  Description of Artificial Sequence: Synthetic oligonucleotide
gcggactcgcgcgagtccgcc

SEQ ID NO: 11398 - DNA, 21 bp, Artificial Sequence
  Description of Artificial Sequence: Synthetic oligonucleotide
gcggactcgcgcgagtccgct

SEQ ID NO: 11399 - DNA, 21 bp, Artificial Sequence
  Description of Artificial Sequence: Synthetic oligonucleotide
acggactcgcgcgagtccgtc

SEQ ID NO: 11400 - DNA, 21 bp, Artificial Sequence
  Description of Artificial Sequence: Synthetic oligonucleotide
gaggactcgcgcgagtcctcc

SEQ ID NO: 11401 - DNA, 21 bp, Artificial Sequence
  Description of Artificial Sequence: Synthetic oligonucleotide
gcagactcgcgcgagtctgcc

SEQ ID NO: 11402 - DNA, 21 bp, Artificial Sequence
  Description of Artificial Sequence: Synthetic oligonucleotide
gcggactcgcgcgagtccgca

SEQ ID NO: 11403 - DNA, 21 bp, Artificial Sequence
  Description of Artificial Sequence: Synthetic oligonucleotide
tcggactcgcgcgagtccgac

SEQ ID NO: 11404 - DNA, 21 bp, Artificial Sequence
  Description of Artificial Sequence: Synthetic oligonucleotide
gtggactcgcgcgagtccacc

SEQ ID NO: 11405 - DNA, 21 bp, Artificial Sequence
  Description of Artificial Sequence: Synthetic oligonucleotide
gctgactcgcgcgagtcagcc

SEQ ID NO: 11406 - DNA, 21 bp, Artificial Sequence
  Description of Artificial Sequence: Synthetic oligonucleotide
cccgactcgcgcgagtcgggc

SEQ ID NO: 11407 - DNA, 21 bp, Artificial Sequence
  Description of Artificial Sequence: Synthetic oligonucleotide
cccgactcgcgcgagtcgggt

SEQ ID NO: 11408 - DNA, 21 bp, Artificial Sequence
  Description of Artificial Sequence: Synthetic oligonucleotide
accgactcgcgcgagtcggtc

SEQ ID NO: 11409 - DNA, 21 bp, Artificial Sequence
  Description of Artificial Sequence: Synthetic oligonucleotide
cacgactcgcgcgagtcgtgc

SEQ ID NO: 11410 - DNA, 21 bp, Artificial Sequence
  Description of Artificial Sequence: Synthetic oligonucleotide
ccagactcgcgcgagtctggc

SEQ ID NO: 11411 - DNA, 21 bp, Artificial Sequence
  Description of Artificial Sequence: Synthetic oligonucleotide
cccgactcgcgcgagtcggga

SEQ ID NO: 11412 - DNA, 21 bp, Artificial Sequence
  Description of Artificial Sequence: Synthetic oligonucleotide
tccgactcgcgcgagtcggac

SEQ ID NO: 11413 - DNA, 21 bp, Artificial Sequence
  Description of Artificial Sequence: Synthetic oligonucleotide
cctgactcgcgcgagtcaggc

SEQ ID NO: 11414 - DNA, 21 bp, Artificial Sequence
  Description of Artificial Sequence: Synthetic oligonucleotide
ggcgactcgcgcgagtcgccc

SEQ ID NO: 11415 - DNA, 21 bp, Artificial Sequence
  Description of Artificial Sequence: Synthetic oligonucleotide
ggcgactcgcgcgagtcgcct

SEQ ID NO: 11416 - DNA, 21 bp, Artificial Sequence
  Description of Artificial Sequence: Synthetic oligonucleotide
agcgactcgcgcgagtcgctc

SEQ ID NO: 11417 - DNA, 21 bp, Artificial Sequence
  Description of Artificial Sequence: Synthetic oligonucleotide
gacgactcgcgcgagtcgtcc

SEQ ID NO: 11418 - DNA, 21 bp, Artificial Sequence
  Description of Artificial Sequence: Synthetic oligonucleotide
ggagactcgcgcgagtctccc

SEQ ID NO: 11419 - DNA, 21 bp, Artificial Sequence
  Description of Artificial Sequence: Synthetic oligonucleotide
ggcgactcgcgcgagtcgcca

SEQ ID NO: 11420 - DNA, 21 bp, Artificial Sequence
  Description of Artificial Sequence: Synthetic oligonucleotide
tgcgactcgcgcgagtcgcac

SEQ ID NO: 11421 - DNA, 21 bp, Artificial Sequence
  Description of Artificial Sequence: Synthetic oligonucleotide
ggtgactcgcgcgagtcaccc

SEQ ID NO: 11422 - DNA, 21 bp, Artificial Sequence
  Description of Artificial Sequence: Synthetic oligonucleotide
cgggactcgcgcgagtcccgt

SEQ ID NO: 11423 - DNA, 21 bp, Artificial Sequence
  Description of Artificial Sequence: Synthetic oligonucleotide
agggactcgcgcgagtccctg

SEQ ID NO: 11424 - DNA, 21 bp, Artificial Sequence
  Description of Artificial Sequence: Synthetic oligonucleotide
caggactcgcgcgagtcctgg

SEQ ID NO: 11425 - DNA, 21 bp, Artificial Sequence
  Description of Artificial Sequence: Synthetic oligonucleotide
cgagactcgcgcgagtctcgg

SEQ ID NO: 11426 - DNA, 21 bp, Artificial Sequence
  Description of Artificial Sequence: Synthetic oligonucleotide
cgggactcgcgcgagtcccga

SEQ ID NO: 11427 - DNA, 21 bp, Artificial Sequence
  Description of Artificial Sequence: Synthetic oligonucleotide
tgggactcgcgcgagtcccag

SEQ ID NO: 11428 - DNA, 21 bp, Artificial Sequence
  Description of Artificial Sequence: Synthetic oligonucleotide
ctggactcgcgcgagtccagg

SEQ ID NO: 11429 - DNA, 21 bp, Artificial Sequence
  Description of Artificial Sequence: Synthetic oligonucleotide
cgtgactcgcgcgagtcacgg

SEQ ID NO: 11430 - DNA, 21 bp, Artificial Sequence
  Description of Artificial Sequence: Synthetic oligonucleotide
ggcgactcgcgcgagtcgccg

SEQ ID NO: 11431 - DNA, 21 bp, Artificial Sequence
  Description of Artificial Sequence: Synthetic oligonucleotide
agcgactcgcgcgagtcgctg

SEQ ID NO: 11432 - DNA, 21 bp, Artificial Sequence
  Description of Artificial Sequence: Synthetic oligonucleotide
gacgactcgcgcgagtcgtcg

SEQ ID NO: 11433 - DNA, 21 bp, Artificial Sequence
  Description of Artificial Sequence: Synthetic oligonucleotide
ggagactcgcgcgagtctccg

SEQ ID NO: 11434 - DNA, 21 bp, Artificial Sequence
  Description of Artificial Sequence: Synthetic oligonucleotide
tgcgactcgcgcgagtcgcag

SEQ ID NO: 11435 - DNA, 21 bp, Artificial Sequence
  Description of Artificial Sequence: Synthetic oligonucleotide
ggtgactcgcgcgagtcaccg

SEQ ID NO: 11436 - DNA, 21 bp, Artificial Sequence
  Description of Artificial Sequence: Synthetic oligonucleotide
acggactcgcgcgagtccgtg

SEQ ID NO: 11437 - DNA, 21 bp, Artificial Sequence
  Description of Artificial Sequence: Synthetic oligonucleotide
ccagactcgcgcgagtctggg

SEQ ID NO: 11438 - DNA, 21 bp, Artificial Sequence
  Description of Artificial Sequence: Synthetic oligonucleotide
tcggactcgcgcgagtccgag

SEQ ID NO: 11439 - DNA, 21 bp, Artificial Sequence
  Description of Artificial Sequence: Synthetic oligonucleotide
cctgactcgcgcgagtcaggg

SEQ ID NO: 11440 - DNA, 21 bp, Artificial Sequence
  Description of Artificial Sequence: Synthetic oligonucleotide
cacgactcgcgcgagtcgtgg

SEQ ID NO: 11441 - DNA, 21 bp, Artificial Sequence
  Description of Artificial Sequence: Synthetic oligonucleotide
gccgactcgcgcgagtcggct

SEQ ID NO: 11442 - DNA, 21 bp, Artificial Sequence
  Description of Artificial Sequence: Synthetic oligonucleotide
gccgactcgcgcgagtcggca

SEQ ID NO: 11443 - DNA, 21 bp, Artificial Sequence
  Description of Artificial Sequence: Synthetic oligonucleotide
cgagactcgcgcgagtctcgc

SEQ ID NO: 11444 - DNA, 21 bp, Artificial Sequence
  Description of Artificial Sequence: Synthetic oligonucleotide
cgtgactcgcgcgagtcacgc

SEQ ID NO: 11445 - DNA, 21 bp, Artificial Sequence
  Description of Artificial Sequence: Synthetic oligonucleotide
caggactcgcgcgagtcctgc

SEQ ID NO: 11446 - DNA, 21 bp, Artificial Sequence
  Description of Artificial Sequence: Synthetic oligonucleotide
ctggactcgcgcgagtccagc

SEQ ID NO: 11447 - DNA, 21 bp, Artificial Sequence
  Description of Artificial Sequence: Synthetic oligonucleotide
gaggactcgcgcgagtcctcg

SEQ ID NO: 11448 - DNA, 21 bp, Artificial Sequence
  Description of Artificial Sequence: Synthetic oligonucleotide
gtggactcgcgcgagtccacg

SEQ ID NO: 11449 - DNA, 21 bp, Artificial Sequence
  Description of Artificial Sequence: Synthetic oligonucleotide
accgactcgcgcgagtcggtg

SEQ ID NO: 11450 - DNA, 21 bp, Artificial Sequence
  Description of Artificial Sequence: Synthetic oligonucleotide
tccgactcgcgcgagtcggag

SEQ ID NO: 11451 - DNA, 21 bp, Artificial Sequence
  Description of Artificial Sequence: Synthetic oligonucleotide
cgggactcgcgcgagtcccgc

SEQ ID NO: 11452 - DNA, 21 bp, Artificial Sequence
  Description of Artificial Sequence: Synthetic oligonucleotide
agggactcgcgcgagtccctc

SEQ ID NO: 11453 - DNA, 21 bp, Artificial Sequence
  Description of Artificial Sequence: Synthetic oligonucleotide
tgggactcgcgcgagtcccac

SEQ ID NO: 11454 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcacgtgagtcnnnn

SEQ ID NO: 11455 - DNA, 21 bp, Artificial Sequence
  Description of Artificial Sequence: Synthetic oligonucleotide
gcggactcacgtgagtccgcc

SEQ ID NO: 11456 - DNA, 21 bp, Artificial Sequence
  Description of Artificial Sequence: Synthetic oligonucleotide
gcggactcacgtgagtccgct

SEQ ID NO: 11457 - DNA, 21 bp, Artificial Sequence
  Description of Artificial Sequence: Synthetic oligonucleotide
acggactcacgtgagtccgtc

SEQ ID NO: 11458 - DNA, 21 bp, Artificial Sequence
  Description of Artificial Sequence: Synthetic oligonucleotide
gaggactcacgtgagtcctcc

SEQ ID NO: 11459 - DNA, 21 bp, Artificial Sequence
  Description of Artificial Sequence: Synthetic oligonucleotide
gcagactcacgtgagtctgcc

SEQ ID NO: 11460 - DNA, 21 bp, Artificial Sequence
  Description of Artificial Sequence: Synthetic oligonucleotide
gcggactcacgtgagtccgca

SEQ ID NO: 11461 - DNA, 21 bp, Artificial Sequence
  Description of Artificial Sequence: Synthetic oligonucleotide
tcggactcacgtgagtccgac

SEQ ID NO: 11462 - DNA, 21 bp, Artificial Sequence
  Description of Artificial Sequence: Synthetic oligonucleotide
gtggactcacgtgagtccacc

SEQ ID NO: 11463 - DNA, 21 bp, Artificial Sequence
  Description of Artificial Sequence: Synthetic oligonucleotide
gctgactcacgtgagtcagcc

SEQ ID NO: 11464 - DNA, 21 bp, Artificial Sequence
  Description of Artificial Sequence: Synthetic oligonucleotide
cccgactcacgtgagtcgggc

SEQ ID NO: 11465 - DNA, 21 bp, Artificial Sequence
  Description of Artificial Sequence: Synthetic oligonucleotide
cccgactcacgtgagtcgggt

SEQ ID NO: 11466 - DNA, 21 bp, Artificial Sequence
  Description of Artificial Sequence: Synthetic oligonucleotide
accgactcacgtgagtcggtc

SEQ ID NO: 11467 - DNA, 21 bp, Artificial Sequence
  Description of Artificial Sequence: Synthetic oligonucleotide
cacgactcacgtgagtcgtgc

SEQ ID NO: 11468 - DNA, 21 bp, Artificial Sequence
  Description of Artificial Sequence: Synthetic oligonucleotide
ccagactcacgtgagtctggc

SEQ ID NO: 11469 - DNA, 21 bp, Artificial Sequence
  Description of Artificial Sequence: Synthetic oligonucleotide
cccgactcacgtgagtcggga

SEQ ID NO: 11470 - DNA, 21 bp, Artificial Sequence
  Description of Artificial Sequence: Synthetic oligonucleotide
tccgactcacgtgagtcggac

SEQ ID NO: 11471 - DNA, 21 bp, Artificial Sequence
  Description of Artificial Sequence: Synthetic oligonucleotide
cctgactcacgtgagtcaggc

SEQ ID NO: 11472 - DNA, 21 bp, Artificial Sequence
  Description of Artificial Sequence: Synthetic oligonucleotide
ggcgactcacgtgagtcgccc

SEQ ID NO: 11473 - DNA, 21 bp, Artificial Sequence
  Description of Artificial Sequence: Synthetic oligonucleotide
ggcgactcacgtgagtcgcct

SEQ ID NO: 11474 - DNA, 21 bp, Artificial Sequence
  Description of Artificial Sequence: Synthetic oligonucleotide
agcgactcacgtgagtcgctc

SEQ ID NO: 11475 - DNA, 21 bp, Artificial Sequence
  Description of Artificial Sequence: Synthetic oligonucleotide
gacgactcacgtgagtcgtcc

SEQ ID NO: 11476 - DNA, 21 bp, Artificial Sequence
  Description of Artificial Sequence: Synthetic oligonucleotide
ggagactcacgtgagtctccc

SEQ ID NO: 11477 - DNA, 21 bp, Artificial Sequence
  Description of Artificial Sequence: Synthetic oligonucleotide
ggcgactcacgtgagtcgcca

SEQ ID NO: 11478 - DNA, 21 bp, Artificial Sequence
  Description of Artificial Sequence: Synthetic oligonucleotide
tgcgactcacgtgagtcgcac

SEQ ID NO: 11479 - DNA, 21 bp, Artificial Sequence
  Description of Artificial Sequence: Synthetic oligonucleotide
ggtgactcacgtgagtcaccc

SEQ ID NO: 11480 - DNA, 21 bp, Artificial Sequence
  Description of Artificial Sequence: Synthetic oligonucleotide
cgggactcacgtgagtcccgt

SEQ ID NO: 11481 - DNA, 21 bp, Artificial Sequence
  Description of Artificial Sequence: Synthetic oligonucleotide
agggactcacgtgagtccctg

SEQ ID NO: 11482 - DNA, 21 bp, Artificial Sequence
  Description of Artificial Sequence: Synthetic oligonucleotide
caggactcacgtgagtcctgg

SEQ ID NO: 11483 - DNA, 21 bp, Artificial Sequence
  Description of Artificial Sequence: Synthetic oligonucleotide
cgagactcacgtgagtctcgg

SEQ ID NO: 11484 - DNA, 21 bp, Artificial Sequence
  Description of Artificial Sequence: Synthetic oligonucleotide
cgggactcacgtgagtcccga

SEQ ID NO: 11485 - DNA, 21 bp, Artificial Sequence
  Description of Artificial Sequence: Synthetic oligonucleotide
tgggactcacgtgagtcccag

SEQ ID NO: 11486 - DNA, 21 bp, Artificial Sequence
  Description of Artificial Sequence: Synthetic oligonucleotide
ctggactcacgtgagtccagg

SEQ ID NO: 11487 - DNA, 21 bp, Artificial Sequence
  Description of Artificial Sequence: Synthetic oligonucleotide
cgtgactcacgtgagtcacgg

SEQ ID NO: 11488 - DNA, 21 bp, Artificial Sequence
  Description of Artificial Sequence: Synthetic oligonucleotide
ggcgactcacgtgagtcgccg

SEQ ID NO: 11489 - DNA, 21 bp, Artificial Sequence
  Description of Artificial Sequence: Synthetic oligonucleotide
agcgactcacgtgagtcgctg

SEQ ID NO: 11490 - DNA, 21 bp, Artificial Sequence
  Description of Artificial Sequence: Synthetic oligonucleotide
gacgactcacgtgagtcgtcg

SEQ ID NO: 11491 - DNA, 21 bp, Artificial Sequence
  Description of Artificial Sequence: Synthetic oligonucleotide
ggagactcacgtgagtctccg

SEQ ID NO: 11492 - DNA, 21 bp, Artificial Sequence
  Description of Artificial Sequence: Synthetic oligonucleotide
tgcgactcacgtgagtcgcag

SEQ ID NO: 11493 - DNA, 21 bp, Artificial Sequence
  Description of Artificial Sequence: Synthetic oligonucleotide
ggtgactcacgtgagtcaccg

SEQ ID NO: 11494 - DNA, 21 bp, Artificial Sequence
  Description of Artificial Sequence: Synthetic oligonucleotide
acggactcacgtgagtccgtg

SEQ ID NO: 11495 - DNA, 21 bp, Artificial Sequence
  Description of Artificial Sequence: Synthetic oligonucleotide
ccagactcacgtgagtctggg

SEQ ID NO: 11496 - DNA, 21 bp, Artificial Sequence
  Description of Artificial Sequence: Synthetic oligonucleotide
tcggactcacgtgagtccgag

SEQ ID NO: 11497 - DNA, 21 bp, Artificial Sequence
  Description of Artificial Sequence: Synthetic oligonucleotide
cctgactcacgtgagtcaggg

SEQ ID NO: 11498 - DNA, 21 bp, Artificial Sequence
  Description of Artificial Sequence: Synthetic oligonucleotide
cacgactcacgtgagtcgtgg

SEQ ID NO: 11499 - DNA, 21 bp, Artificial Sequence
  Description of Artificial Sequence: Synthetic oligonucleotide
gccgactcacgtgagtcggct

SEQ ID NO: 11500 - DNA, 21 bp, Artificial Sequence
  Description of Artificial Sequence: Synthetic oligonucleotide
gccgactcacgtgagtcggca

SEQ ID NO: 11501 - DNA, 21 bp, Artificial Sequence
  Description of Artificial Sequence: Synthetic oligonucleotide
cgagactcacgtgagtctcgc

SEQ ID NO: 11502 - DNA, 21 bp, Artificial Sequence
  Description of Artificial Sequence: Synthetic oligonucleotide
cgtgactcacgtgagtcacgc

SEQ ID NO: 11503 - DNA, 21 bp, Artificial Sequence
  Description of Artificial Sequence: Synthetic oligonucleotide
caggactcacgtgagtcctgc

SEQ ID NO: 11504 - DNA, 21 bp, Artificial Sequence
  Description of Artificial Sequence: Synthetic oligonucleotide
ctggactcacgtgagtccagc

SEQ ID NO: 11505 - DNA, 21 bp, Artificial Sequence
  Description of Artificial Sequence: Synthetic oligonucleotide
gaggactcacgtgagtcctcg

SEQ ID NO: 11506 - DNA, 21 bp, Artificial Sequence
  Description of Artificial Sequence: Synthetic oligonucleotide
gtggactcacgtgagtccacg

SEQ ID NO: 11507 - DNA, 21 bp, Artificial Sequence
  Description of Artificial Sequence: Synthetic oligonucleotide
accgactcacgtgagtcggtg

SEQ ID NO: 11508 - DNA, 21 bp, Artificial Sequence
  Description of Artificial Sequence: Synthetic oligonucleotide
tccgactcacgtgagtcggag

SEQ ID NO: 11509 - DNA, 21 bp, Artificial Sequence
  Description of Artificial Sequence: Synthetic oligonucleotide
cgggactcacgtgagtcccgc

SEQ ID NO: 11510 - DNA, 21 bp, Artificial Sequence
  Description of Artificial Sequence: Synthetic oligonucleotide
agggactcacgtgagtccctc

SEQ ID NO: 11511 - DNA, 21 bp, Artificial Sequence
  Description of Artificial Sequence: Synthetic oligonucleotide
tgggactcacgtgagtcccac

SEQ ID NO: 11512 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcggccgagtcnnnn

SEQ ID NO: 11513 - DNA, 21 bp, Artificial Sequence
  Description of Artificial Sequence: Synthetic oligonucleotide
gcggactcggccgagtccgcc

SEQ ID NO: 11514 - DNA, 21 bp, Artificial Sequence
  Description of Artificial Sequence: Synthetic oligonucleotide
gcggactcggccgagtccgct

SEQ ID NO: 11515 - DNA, 21 bp, Artificial Sequence
  Description of Artificial Sequence: Synthetic oligonucleotide
acggactcggccgagtccgtc

SEQ ID NO: 11516 - DNA, 21 bp, Artificial Sequence
  Description of Artificial Sequence: Synthetic oligonucleotide
gaggactcggccgagtcctcc

SEQ ID NO: 11517 - DNA, 21 bp, Artificial Sequence
  Description of Artificial Sequence: Synthetic oligonucleotide
gcagactcggccgagtctgcc

SEQ ID NO: 11518 - DNA, 21 bp, Artificial Sequence
  Description of Artificial Sequence: Synthetic oligonucleotide
gcggactcggccgagtccgca

SEQ ID NO: 11519 - DNA, 21 bp, Artificial Sequence
  Description of Artificial Sequence: Synthetic oligonucleotide
tcggactcggccgagtccgac

SEQ ID NO: 11520 - DNA, 21 bp, Artificial Sequence
  Description of Artificial Sequence: Synthetic oligonucleotide
gtggactcggccgagtccacc

SEQ ID NO: 11521 - DNA, 21 bp, Artificial Sequence
  Description of Artificial Sequence: Synthetic oligonucleotide
gctgactcggccgagtcagcc

SEQ ID NO: 11522 - DNA, 21 bp, Artificial Sequence
  Description of Artificial Sequence: Synthetic oligonucleotide
cccgactcggccgagtcgggc

SEQ ID NO: 11523 - DNA, 21 bp, Artificial Sequence
  Description of Artificial Sequence: Synthetic oligonucleotide
cccgactcggccgagtcgggt

SEQ ID NO: 11524 - DNA, 21 bp, Artificial Sequence
  Description of Artificial Sequence: Synthetic oligonucleotide
accgactcggccgagtcggtc

SEQ ID NO: 11525 - DNA, 21 bp, Artificial Sequence
  Description of Artificial Sequence: Synthetic oligonucleotide
cacgactcggccgagtcgtgc

SEQ ID NO: 11526 - DNA, 21 bp, Artificial Sequence
  Description of Artificial Sequence: Synthetic oligonucleotide
ccagactcggccgagtctggc

SEQ ID NO: 11527 - DNA, 21 bp, Artificial Sequence
  Description of Artificial Sequence: Synthetic oligonucleotide
cccgactcggccgagtcggga

SEQ ID NO: 11528 - DNA, 21 bp, Artificial Sequence
  Description of Artificial Sequence: Synthetic oligonucleotide
tccgactcggccgagtcggac

SEQ ID NO: 11529 - DNA, 21 bp, Artificial Sequence
  Description of Artificial Sequence: Synthetic oligonucleotide
cctgactcggccgagtcaggc

SEQ ID NO: 11530 - DNA, 21 bp, Artificial Sequence
  Description of Artificial Sequence: Synthetic oligonucleotide
ggcgactcggccgagtcgccc

SEQ ID NO: 11531 - DNA, 21 bp, Artificial Sequence
  Description of Artificial Sequence: Synthetic oligonucleotide
ggcgactcggccgagtcgcct

SEQ ID NO: 11532 - DNA, 21 bp, Artificial Sequence
  Description of Artificial Sequence: Synthetic oligonucleotide
agcgactcggccgagtcgctc

SEQ ID NO: 11533 - DNA, 21 bp, Artificial Sequence
  Description of Artificial Sequence: Synthetic oligonucleotide
gacgactcggccgagtcgtcc

SEQ ID NO: 11534 - DNA, 21 bp, Artificial Sequence
  Description of Artificial Sequence: Synthetic oligonucleotide
ggagactcggccgagtctccc

SEQ ID NO: 11535 - DNA, 21 bp, Artificial Sequence
  Description of Artificial Sequence: Synthetic oligonucleotide
ggcgactcggccgagtcgcca

SEQ ID NO: 11536 - DNA, 21 bp, Artificial Sequence
  Description of Artificial Sequence: Synthetic oligonucleotide
tgcgactcggccgagtcgcac

SEQ ID NO: 11537 - DNA, 21 bp, Artificial Sequence
  Description of Artificial Sequence: Synthetic oligonucleotide
ggtgactcggccgagtcaccc

SEQ ID NO: 11538 - DNA, 21 bp, Artificial Sequence
  Description of Artificial Sequence: Synthetic oligonucleotide
cgggactcggccgagtcccgt

SEQ ID NO: 11539 - DNA, 21 bp, Artificial Sequence
  Description of Artificial Sequence: Synthetic oligonucleotide
agggactcggccgagtccctg

SEQ ID NO: 11540 - DNA, 21 bp, Artificial Sequence
  Description of Artificial Sequence: Synthetic oligonucleotide
caggactcggccgagtcctgg

SEQ ID NO: 11541 - DNA, 21 bp, Artificial Sequence
  Description of Artificial Sequence: Synthetic oligonucleotide
cgagactcggccgagtctcgg

SEQ ID NO: 11542 - DNA, 21 bp, Artificial Sequence
  Description of Artificial Sequence: Synthetic oligonucleotide
cgggactcggccgagtcccga

SEQ ID NO: 11543 - DNA, 21 bp, Artificial Sequence
  Description of Artificial Sequence: Synthetic oligonucleotide
tgggactcggccgagtcccag

SEQ ID NO: 11544 - DNA, 21 bp, Artificial Sequence
  Description of Artificial Sequence: Synthetic oligonucleotide
ctggactcggccgagtccagg

SEQ ID NO: 11545 - DNA, 21 bp, Artificial Sequence
  Description of Artificial Sequence: Synthetic oligonucleotide
cgtgactcggccgagtcacgg

SEQ ID NO: 11546 - DNA, 21 bp, Artificial Sequence
  Description of Artificial Sequence: Synthetic oligonucleotide
ggcgactcggccgagtcgccg

SEQ ID NO: 11547 - DNA, 21 bp, Artificial Sequence
  Description of Artificial Sequence: Synthetic oligonucleotide
agcgactcggccgagtcgctg

SEQ ID NO: 11548 - DNA, 21 bp, Artificial Sequence
  Description of Artificial Sequence: Synthetic oligonucleotide
gacgactcggccgagtcgtcg

SEQ ID NO: 11549 - DNA, 21 bp, Artificial Sequence
  Description of Artificial Sequence: Synthetic oligonucleotide
ggagactcggccgagtctccg

SEQ ID NO: 11550 - DNA, 21 bp, Artificial Sequence
  Description of Artificial Sequence: Synthetic oligonucleotide
tgcgactcggccgagtcgcag

SEQ ID NO: 11551 - DNA, 21 bp, Artificial Sequence
  Description of Artificial Sequence: Synthetic oligonucleotide
ggtgactcggccgagtcaccg

SEQ ID NO: 11552 - DNA, 21 bp, Artificial Sequence
  Description of Artificial Sequence: Synthetic oligonucleotide
acggactcggccgagtccgtg

SEQ ID NO: 11553 - DNA, 21 bp, Artificial Sequence
  Description of Artificial Sequence: Synthetic oligonucleotide
ccagactcggccgagtctggg

SEQ ID NO: 11554 - DNA, 21 bp, Artificial Sequence
  Description of Artificial Sequence: Synthetic oligonucleotide
tcggactcggccgagtccgag

SEQ ID NO: 11555 - DNA, 21 bp, Artificial Sequence
  Description of Artificial Sequence: Synthetic oligonucleotide
cctgactcggccgagtcaggg

SEQ ID NO: 11556 - DNA, 21 bp, Artificial Sequence
  Description of Artificial Sequence: Synthetic oligonucleotide
cacgactcggccgagtcgtgg

SEQ ID NO: 11557 - DNA, 21 bp, Artificial Sequence
  Description of Artificial Sequence: Synthetic oligonucleotide
gccgactcggccgagtcggct

SEQ ID NO: 11558 - DNA, 21 bp, Artificial Sequence
  Description of Artificial Sequence: Synthetic oligonucleotide
gccgactcggccgagtcggca

SEQ ID NO: 11559 - DNA, 21 bp, Artificial Sequence
  Description of Artificial Sequence: Synthetic oligonucleotide
cgagactcggccgagtctcgc

SEQ ID NO: 11560 - DNA, 21 bp, Artificial Sequence
  Description of Artificial Sequence: Synthetic oligonucleotide
cgtgactcggccgagtcacgc

SEQ ID NO: 11561 - DNA, 21 bp, Artificial Sequence
  Description of Artificial Sequence: Synthetic oligonucleotide
caggactcggccgagtcctgc

SEQ ID NO: 11562 - DNA, 21 bp, Artificial Sequence
  Description of Artificial Sequence: Synthetic oligonucleotide
ctggactcggccgagtccagc

SEQ ID NO: 11563 - DNA, 21 bp, Artificial Sequence
  Description of Artificial Sequence: Synthetic oligonucleotide
gaggactcggccgagtcctcg

SEQ ID NO: 11564 - DNA, 21 bp, Artificial Sequence
  Description of Artificial Sequence: Synthetic oligonucleotide
gtggactcggccgagtccacg

SEQ ID NO: 11565 - DNA, 21 bp, Artificial Sequence
  Description of Artificial Sequence: Synthetic oligonucleotide
accgactcggccgagtcggtg

SEQ ID NO: 11566 - DNA, 21 bp, Artificial Sequence
  Description of Artificial Sequence: Synthetic oligonucleotide
tccgactcggccgagtcggag

SEQ ID NO: 11567 - DNA, 21 bp, Artificial Sequence
  Description of Artificial Sequence: Synthetic oligonucleotide
cgggactcggccgagtcccgc

SEQ ID NO: 11568 - DNA, 21 bp, Artificial Sequence
  Description of Artificial Sequence: Synthetic oligonucleotide
agggactcggccgagtccctc

SEQ ID NO: 11569 - DNA, 21 bp, Artificial Sequence
  Description of Artificial Sequence: Synthetic oligonucleotide
tgggactcggccgagtcccac

SEQ ID NO: 11570 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcccgggagtcnnnn

SEQ ID NO: 11571 - DNA, 21 bp, Artificial Sequence
  Description of Artificial Sequence: Synthetic oligonucleotide
gcggactcccgggagtccgcc

SEQ ID NO: 11572 - DNA, 21 bp, Artificial Sequence
  Description of Artificial Sequence: Synthetic oligonucleotide
gcggactcccgggagtccgct

SEQ ID NO: 11573 - DNA, 21 bp, Artificial Sequence
  Description of Artificial Sequence: Synthetic oligonucleotide
acggactcccgggagtccgtc

SEQ ID NO: 11574 - DNA, 21 bp, Artificial Sequence
  Description of Artificial Sequence: Synthetic oligonucleotide
gaggactcccgggagtcctcc

SEQ ID NO: 11575 - DNA, 21 bp, Artificial Sequence
  Description of Artificial Sequence: Synthetic oligonucleotide
gcagactcccgggagtctgcc

SEQ ID NO: 11576 - DNA, 21 bp, Artificial Sequence
  Description of Artificial Sequence: Synthetic oligonucleotide
gcggactcccgggagtccgca

SEQ ID NO: 11577 - DNA, 21 bp, Artificial Sequence
  Description of Artificial Sequence: Synthetic oligonucleotide
tcggactcccgggagtccgac

SEQ ID NO: 11578 - DNA, 21 bp, Artificial Sequence
  Description of Artificial Sequence: Synthetic oligonucleotide
gtggactcccgggagtccacc

SEQ ID NO: 11579 - DNA, 21 bp, Artificial Sequence
  Description of Artificial Sequence: Synthetic oligonucleotide
gctgactcccgggagtcagcc

SEQ ID NO: 11580 - DNA, 21 bp, Artificial Sequence
  Description of Artificial Sequence: Synthetic oligonucleotide
cccgactcccgggagtcgggc

SEQ ID NO: 11581 - DNA, 21 bp, Artificial Sequence
  Description of Artificial Sequence: Synthetic oligonucleotide
cccgactcccgggagtcgggt

SEQ ID NO: 11582 - DNA, 21 bp, Artificial Sequence
  Description of Artificial Sequence: Synthetic oligonucleotide
accgactcccgggagtcggtc

SEQ ID NO: 11583 - DNA, 21 bp, Artificial Sequence
  Description of Artificial Sequence: Synthetic oligonucleotide
cacgactcccgggagtcgtgc

SEQ ID NO: 11584 - DNA, 21 bp, Artificial Sequence
  Description of Artificial Sequence: Synthetic oligonucleotide
ccagactcccgggagtctggc

SEQ ID NO: 11585 - DNA, 21 bp, Artificial Sequence
  Description of Artificial Sequence: Synthetic oligonucleotide
cccgactcccgggagtcggga

SEQ ID NO: 11586 - DNA, 21 bp, Artificial Sequence
  Description of Artificial Sequence: Synthetic oligonucleotide
tccgactcccgggagtcggac

SEQ ID NO: 11587 - DNA, 21 bp, Artificial Sequence
  Description of Artificial Sequence: Synthetic oligonucleotide
cctgactcccgggagtcaggc

SEQ ID NO: 11588 - DNA, 21 bp, Artificial Sequence
  Description of Artificial Sequence: Synthetic oligonucleotide
ggcgactcccgggagtcgccc

SEQ ID NO: 11589 - DNA, 21 bp, Artificial Sequence
  Description of Artificial Sequence: Synthetic oligonucleotide
ggcgactcccgggagtcgcct

SEQ ID NO: 11590 - DNA, 21 bp, Artificial Sequence
  Description of Artificial Sequence: Synthetic oligonucleotide
agcgactcccgggagtcgctc

SEQ ID NO: 11591 - DNA, 21 bp, Artificial Sequence
  Description of Artificial Sequence: Synthetic oligonucleotide
gacgactcccgggagtcgtcc

SEQ ID NO: 11592 - DNA, 21 bp, Artificial Sequence
  Description of Artificial Sequence: Synthetic oligonucleotide
ggagactcccgggagtctccc

SEQ ID NO: 11593 - DNA, 21 bp, Artificial Sequence
  Description of Artificial Sequence: Synthetic oligonucleotide
ggcgactcccgggagtcgcca

SEQ ID NO: 11594 - DNA, 21 bp, Artificial Sequence
  Description of Artificial Sequence: Synthetic oligonucleotide
tgcgactcccgggagtcgcac

SEQ ID NO: 11595 - DNA, 21 bp, Artificial Sequence
  Description of Artificial Sequence: Synthetic oligonucleotide
ggtgactcccgggagtcaccc

SEQ ID NO: 11596 - DNA, 21 bp, Artificial Sequence
  Description of Artificial Sequence: Synthetic oligonucleotide
cgggactcccgggagtcccgt

SEQ ID NO: 11597 - DNA, 21 bp, Artificial Sequence
  Description of Artificial Sequence: Synthetic oligonucleotide
agggactcccgggagtccctg

SEQ ID NO: 11598 - DNA, 21 bp, Artificial Sequence
  Description of Artificial Sequence: Synthetic oligonucleotide
caggactcccgggagtcctgg

SEQ ID NO: 11599 - DNA, 21 bp, Artificial Sequence
  Description of Artificial Sequence: Synthetic oligonucleotide
cgagactcccgggagtctcgg

SEQ ID NO: 11600 - DNA, 21 bp, Artificial Sequence
  Description of Artificial Sequence: Synthetic oligonucleotide
cgggactcccgggagtcccga

SEQ ID NO: 11601 - DNA, 21 bp, Artificial Sequence
  Description of Artificial Sequence: Synthetic oligonucleotide
tgggactcccgggagtcccag

SEQ ID NO: 11602 - DNA, 21 bp, Artificial Sequence
  Description of Artificial Sequence: Synthetic oligonucleotide
ctggactcccgggagtccagg

SEQ ID NO: 11603 - DNA, 21 bp, Artificial Sequence
  Description of Artificial Sequence: Synthetic oligonucleotide
cgtgactcccgggagtcacgg

SEQ ID NO: 11604 - DNA, 21 bp, Artificial Sequence
  Description of Artificial Sequence: Synthetic oligonucleotide
ggcgactcccgggagtcgccg

SEQ ID NO: 11605 - DNA, 21 bp, Artificial Sequence
  Description of Artificial Sequence: Synthetic oligonucleotide
agcgactcccgggagtcgctg

SEQ ID NO: 11606 - DNA, 21 bp, Artificial Sequence
  Description of Artificial Sequence: Synthetic oligonucleotide
gacgactcccgggagtcgtcg

SEQ ID NO: 11607 - DNA, 21 bp, Artificial Sequence
  Description of Artificial Sequence: Synthetic oligonucleotide
ggagactcccgggagtctccg

SEQ ID NO: 11608 - DNA, 21 bp, Artificial Sequence
  Description of Artificial Sequence: Synthetic oligonucleotide
tgcgactcccgggagtcgcag

SEQ ID NO: 11609 - DNA, 21 bp, Artificial Sequence
  Description of Artificial Sequence: Synthetic oligonucleotide
ggtgactcccgggagtcaccg

SEQ ID NO: 11610 - DNA, 21 bp, Artificial Sequence
  Description of Artificial Sequence: Synthetic oligonucleotide
acggactcccgggagtccgtg

SEQ ID NO: 11611 - DNA, 21 bp, Artificial Sequence
  Description of Artificial Sequence: Synthetic oligonucleotide
ccagactcccgggagtctggg

SEQ ID NO: 11612 - DNA, 21 bp, Artificial Sequence
  Description of Artificial Sequence: Synthetic oligonucleotide
tcggactcccgggagtccgag

SEQ ID NO: 11613 - DNA, 21 bp, Artificial Sequence
  Description of Artificial Sequence: Synthetic oligonucleotide
cctgactcccgggagtcaggg

SEQ ID NO: 11614 - DNA, 21 bp, Artificial Sequence
  Description of Artificial Sequence: Synthetic oligonucleotide
cacgactcccgggagtcgtgg

SEQ ID NO: 11615 - DNA, 21 bp, Artificial Sequence
  Description of Artificial Sequence: Synthetic oligonucleotide
gccgactcccgggagtcggct

SEQ ID NO: 11616 - DNA, 21 bp, Artificial Sequence
  Description of Artificial Sequence: Synthetic oligonucleotide
gccgactcccgggagtcggca

SEQ ID NO: 11617 - DNA, 21 bp, Artificial Sequence
  Description of Artificial Sequence: Synthetic oligonucleotide
cgagactcccgggagtctcgc

SEQ ID NO: 11618 - DNA, 21 bp, Artificial Sequence
  Description of Artificial Sequence: Synthetic oligonucleotide
cgtgactcccgggagtcacgc

SEQ ID NO: 11619 - DNA, 21 bp, Artificial Sequence
  Description of Artificial Sequence: Synthetic oligonucleotide
caggactcccgggagtcctgc

SEQ ID NO: 11620 - DNA, 21 bp, Artificial Sequence
  Description of Artificial Sequence: Synthetic oligonucleotide
ctggactcccgggagtccagc

SEQ ID NO: 11621 - DNA, 21 bp, Artificial Sequence
  Description of Artificial Sequence: Synthetic oligonucleotide
gaggactcccgggagtcctcg

SEQ ID NO: 11622 - DNA, 21 bp, Artificial Sequence
  Description of Artificial Sequence: Synthetic oligonucleotide
gtggactcccgggagtccacg

SEQ ID NO: 11623 - DNA, 21 bp, Artificial Sequence
  Description of Artificial Sequence: Synthetic oligonucleotide
accgactcccgggagtcggtg

SEQ ID NO: 11624 - DNA, 21 bp, Artificial Sequence
  Description of Artificial Sequence: Synthetic oligonucleotide
tccgactcccgggagtcggag

SEQ ID NO: 11625 - DNA, 21 bp, Artificial Sequence
  Description of Artificial Sequence: Synthetic oligonucleotide
cgggactcccgggagtcccgc

SEQ ID NO: 11626 - DNA, 21 bp, Artificial Sequence
  Description of Artificial Sequence: Synthetic oligonucleotide
agggactcccgggagtccctc

SEQ ID NO: 11627 - DNA, 21 bp, Artificial Sequence
  Description of Artificial Sequence: Synthetic oligonucleotide
tgggactcccgggagtcccac

SEQ ID NO: 11628 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcgtacgagtcnnnn

SEQ ID NO: 11629 - DNA, 21 bp, Artificial Sequence
  Description of Artificial Sequence: Synthetic oligonucleotide
gcggactcgtacgagtccgcc

SEQ ID NO: 11630 - DNA, 21 bp, Artificial Sequence
  Description of Artificial Sequence: Synthetic oligonucleotide
gcggactcgtacgagtccgct

SEQ ID NO: 11631 - DNA, 21 bp, Artificial Sequence
  Description of Artificial Sequence: Synthetic oligonucleotide
acggactcgtacgagtccgtc

SEQ ID NO: 11632 - DNA, 21 bp, Artificial Sequence
  Description of Artificial Sequence: Synthetic oligonucleotide
gaggactcgtacgagtcctcc

SEQ ID NO: 11633 - DNA, 21 bp, Artificial Sequence
  Description of Artificial Sequence: Synthetic oligonucleotide
gcagactcgtacgagtctgcc

SEQ ID NO: 11634 - DNA, 21 bp, Artificial Sequence
  Description of Artificial Sequence: Synthetic oligonucleotide
gcggactcgtacgagtccgca

SEQ ID NO: 11635 - DNA, 21 bp, Artificial Sequence
  Description of Artificial Sequence: Synthetic oligonucleotide
tcggactcgtacgagtccgac

SEQ ID NO: 11636 - DNA, 21 bp, Artificial Sequence
  Description of Artificial Sequence: Synthetic oligonucleotide
gtggactcgtacgagtccacc

SEQ ID NO: 11637 - DNA, 21 bp, Artificial Sequence
  Description of Artificial Sequence: Synthetic oligonucleotide
gctgactcgtacgagtcagcc

SEQ ID NO: 11638 - DNA, 21 bp, Artificial Sequence
  Description of Artificial Sequence: Synthetic oligonucleotide
cccgactcgtacgagtcgggc

SEQ ID NO: 11639 - DNA, 21 bp, Artificial Sequence
  Description of Artificial Sequence: Synthetic oligonucleotide
cccgactcgtacgagtcgggt

SEQ ID NO: 11640 - DNA, 21 bp, Artificial Sequence
  Description of Artificial Sequence: Synthetic oligonucleotide
accgactcgtacgagtcggtc

SEQ ID NO: 11641 - DNA, 21 bp, Artificial Sequence
  Description of Artificial Sequence: Synthetic oligonucleotide
cacgactcgtacgagtcgtgc

SEQ ID NO: 11642 - DNA, 21 bp, Artificial Sequence
  Description of Artificial Sequence: Synthetic oligonucleotide
ccagactcgtacgagtctggc

SEQ ID NO: 11643 - DNA, 21 bp, Artificial Sequence
  Description of Artificial Sequence: Synthetic oligonucleotide
cccgactcgtacgagtcggga

SEQ ID NO: 11644 - DNA, 21 bp, Artificial Sequence
  Description of Artificial Sequence: Synthetic oligonucleotide
tccgactcgtacgagtcggac

SEQ ID NO: 11645 - DNA, 21 bp, Artificial Sequence
  Description of Artificial Sequence: Synthetic oligonucleotide
cctgactcgtacgagtcaggc

SEQ ID NO: 11646 - DNA, 21 bp, Artificial Sequence
  Description of Artificial Sequence: Synthetic oligonucleotide
ggcgactcgtacgagtcgccc

SEQ ID NO: 11647 - DNA, 21 bp, Artificial Sequence
  Description of Artificial Sequence: Synthetic oligonucleotide
ggcgactcgtacgagtcgcct

SEQ ID NO: 11648 - DNA, 21 bp, Artificial Sequence
  Description of Artificial Sequence: Synthetic oligonucleotide
agcgactcgtacgagtcgctc

SEQ ID NO: 11649 - DNA, 21 bp, Artificial Sequence
  Description of Artificial Sequence: Synthetic oligonucleotide
gacgactcgtacgagtcgtcc

SEQ ID NO: 11650 - DNA, 21 bp, Artificial Sequence
  Description of Artificial Sequence: Synthetic oligonucleotide
ggagactcgtacgagtctccc

SEQ ID NO: 11651 - DNA, 21 bp, Artificial Sequence
  Description of Artificial Sequence: Synthetic oligonucleotide
ggcgactcgtacgagtcgcca

SEQ ID NO: 11652 - DNA, 21 bp, Artificial Sequence
  Description of Artificial Sequence: Synthetic oligonucleotide
tgcgactcgtacgagtcgcac

SEQ ID NO: 11653 - DNA, 21 bp, Artificial Sequence
  Description of Artificial Sequence: Synthetic oligonucleotide
ggtgactcgtacgagtcaccc

SEQ ID NO: 11654 - DNA, 21 bp, Artificial Sequence
  Description of Artificial Sequence: Synthetic oligonucleotide
cgggactcgtacgagtcccgt

SEQ ID NO: 11655 - DNA, 21 bp, Artificial Sequence
  Description of Artificial Sequence: Synthetic oligonucleotide
agggactcgtacgagtccctg

SEQ ID NO: 11656 - DNA, 21 bp, Artificial Sequence
  Description of Artificial Sequence: Synthetic oligonucleotide
caggactcgtacgagtcctgg

SEQ ID NO: 11657 - DNA, 21 bp, Artificial Sequence
  Description of Artificial Sequence: Synthetic oligonucleotide
cgagactcgtacgagtctcgg

SEQ ID NO: 11658 - DNA, 21 bp, Artificial Sequence
  Description of Artificial Sequence: Synthetic oligonucleotide
cgggactcgtacgagtcccga

SEQ ID NO: 11659 - DNA, 21 bp, Artificial Sequence
  Description of Artificial Sequence: Synthetic oligonucleotide
tgggactcgtacgagtcccag

SEQ ID NO: 11660 - DNA, 21 bp, Artificial Sequence
  Description of Artificial Sequence: Synthetic oligonucleotide
ctggactcgtacgagtccagg

SEQ ID NO: 11661 - DNA, 21 bp, Artificial Sequence
  Description of Artificial Sequence: Synthetic oligonucleotide
cgtgactcgtacgagtcacgg

SEQ ID NO: 11662 - DNA, 21 bp, Artificial Sequence
  Description of Artificial Sequence: Synthetic oligonucleotide
ggcgactcgtacgagtcgccg

SEQ ID NO: 11663 - DNA, 21 bp, Artificial Sequence
  Description of Artificial Sequence: Synthetic oligonucleotide
agcgactcgtacgagtcgctg

SEQ ID NO: 11664 - DNA, 21 bp, Artificial Sequence
  Description of Artificial Sequence: Synthetic oligonucleotide
gacgactcgtacgagtcgtcg

SEQ ID NO: 11665 - DNA, 21 bp, Artificial Sequence
  Description of Artificial Sequence: Synthetic oligonucleotide
ggagactcgtacgagtctccg

SEQ ID NO: 11666 - DNA, 21 bp, Artificial Sequence
  Description of Artificial Sequence: Synthetic oligonucleotide
tgcgactcgtacgagtcgcag

SEQ ID NO: 11667 - DNA, 21 bp, Artificial Sequence
  Description of Artificial Sequence: Synthetic oligonucleotide
ggtgactcgtacgagtcaccg

SEQ ID NO: 11668 - DNA, 21 bp, Artificial Sequence
  Description of Artificial Sequence: Synthetic oligonucleotide
acggactcgtacgagtccgtg

SEQ ID NO: 11669 - DNA, 21 bp, Artificial Sequence
  Description of Artificial Sequence: Synthetic oligonucleotide
ccagactcgtacgagtctggg

SEQ ID NO: 11670 - DNA, 21 bp, Artificial Sequence
  Description of Artificial Sequence: Synthetic oligonucleotide
tcggactcgtacgagtccgag

SEQ ID NO: 11671 - DNA, 21 bp, Artificial Sequence
  Description of Artificial Sequence: Synthetic oligonucleotide
cctgactcgtacgagtcaggg

SEQ ID NO: 11672 - DNA, 21 bp, Artificial Sequence
  Description of Artificial Sequence: Synthetic oligonucleotide
cacgactcgtacgagtcgtgg

SEQ ID NO: 11673 - DNA, 21 bp, Artificial Sequence
  Description of Artificial Sequence: Synthetic oligonucleotide
gccgactcgtacgagtcggct

SEQ ID NO: 11674 - DNA, 21 bp, Artificial Sequence
  Description of Artificial Sequence: Synthetic oligonucleotide
gccgactcgtacgagtcggca

SEQ ID NO: 11675 - DNA, 21 bp, Artificial Sequence
  Description of Artificial Sequence: Synthetic oligonucleotide
cgagactcgtacgagtctcgc

SEQ ID NO: 11676 - DNA, 21 bp, Artificial Sequence
  Description of Artificial Sequence: Synthetic oligonucleotide
cgtgactcgtacgagtcacgc

SEQ ID NO: 11677 - DNA, 21 bp, Artificial Sequence
  Description of Artificial Sequence: Synthetic oligonucleotide
caggactcgtacgagtcctgc

SEQ ID NO: 11678 - DNA, 21 bp, Artificial Sequence
  Description of Artificial Sequence: Synthetic oligonucleotide
ctggactcgtacgagtccagc

SEQ ID NO: 11679 - DNA, 21 bp, Artificial Sequence
  Description of Artificial Sequence: Synthetic oligonucleotide
gaggactcgtacgagtcctcg

SEQ ID NO: 11680 - DNA, 21 bp, Artificial Sequence
  Description of Artificial Sequence: Synthetic oligonucleotide
gtggactcgtacgagtccacg

SEQ ID NO: 11681 - DNA, 21 bp, Artificial Sequence
  Description of Artificial Sequence: Synthetic oligonucleotide
accgactcgtacgagtcggtg

SEQ ID NO: 11682 - DNA, 21 bp, Artificial Sequence
  Description of Artificial Sequence: Synthetic oligonucleotide
tccgactcgtacgagtcggag

SEQ ID NO: 11683 - DNA, 21 bp, Artificial Sequence
  Description of Artificial Sequence: Synthetic oligonucleotide
cgggactcgtacgagtcccgc

SEQ ID NO: 11684 - DNA, 21 bp, Artificial Sequence
  Description of Artificial Sequence: Synthetic oligonucleotide
agggactcgtacgagtccctc

SEQ ID NO: 11685 - DNA, 21 bp, Artificial Sequence
  Description of Artificial Sequence: Synthetic oligonucleotide
tgggactcgtacgagtcccac

SEQ ID NO: 11686 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcctaggagtcnnnn

SEQ ID NO: 11687 - DNA, 21 bp, Artificial Sequence
  Description of Artificial Sequence: Synthetic oligonucleotide
gcggactcctaggagtccgcc

SEQ ID NO: 11688 - DNA, 21 bp, Artificial Sequence
  Description of Artificial Sequence: Synthetic oligonucleotide
gcggactcctaggagtccgct

SEQ ID NO: 11689 - DNA, 21 bp, Artificial Sequence
  Description of Artificial Sequence: Synthetic oligonucleotide
acggactcctaggagtccgtc

SEQ ID NO: 11690 - DNA, 21 bp, Artificial Sequence
  Description of Artificial Sequence: Synthetic oligonucleotide
gaggactcctaggagtcctcc

SEQ ID NO: 11691 - DNA, 21 bp, Artificial Sequence
  Description of Artificial Sequence: Synthetic oligonucleotide
gcagactcctaggagtctgcc

SEQ ID NO: 11692 - DNA, 21 bp, Artificial Sequence
  Description of Artificial Sequence: Synthetic oligonucleotide
gcggactcctaggagtccgca

SEQ ID NO: 11693 - DNA, 21 bp, Artificial Sequence
  Description of Artificial Sequence: Synthetic oligonucleotide
tcggactcctaggagtccgac

SEQ ID NO: 11694 - DNA, 21 bp, Artificial Sequence
  Description of Artificial Sequence: Synthetic oligonucleotide
gtggactcctaggagtccacc

SEQ ID NO: 11695 - DNA, 21 bp, Artificial Sequence
  Description of Artificial Sequence: Synthetic oligonucleotide
gctgactcctaggagtcagcc

SEQ ID NO: 11696 - DNA, 21 bp, Artificial Sequence
  Description of Artificial Sequence: Synthetic oligonucleotide
cccgactcctaggagtcgggc

SEQ ID NO: 11697 - DNA, 21 bp, Artificial Sequence
  Description of Artificial Sequence: Synthetic oligonucleotide
cccgactcctaggagtcgggt

SEQ ID NO: 11698 - DNA, 21 bp, Artificial Sequence
  Description of Artificial Sequence: Synthetic oligonucleotide
accgactcctaggagtcggtc

SEQ ID NO: 11699 - DNA, 21 bp, Artificial Sequence
  Description of Artificial Sequence: Synthetic oligonucleotide
cacgactcctaggagtcgtgc

SEQ ID NO: 11700 - DNA, 21 bp, Artificial Sequence
  Description of Artificial Sequence: Synthetic oligonucleotide
ccagactcctaggagtctggc

SEQ ID NO: 11701 - DNA, 21 bp, Artificial Sequence
  Description of Artificial Sequence: Synthetic oligonucleotide
cccgactcctaggagtcggga

SEQ ID NO: 11702 - DNA, 21 bp, Artificial Sequence
  Description of Artificial Sequence: Synthetic oligonucleotide
tccgactcctaggagtcggac

SEQ ID NO: 11703 - DNA, 21 bp, Artificial Sequence
  Description of Artificial Sequence: Synthetic oligonucleotide
cctgactcctaggagtcaggc

SEQ ID NO: 11704 - DNA, 21 bp, Artificial Sequence
  Description of Artificial Sequence: Synthetic oligonucleotide
ggcgactcctaggagtcgccc

SEQ ID NO: 11705 - DNA, 21 bp, Artificial Sequence
  Description of Artificial Sequence: Synthetic oligonucleotide
ggcgactcctaggagtcgcct

SEQ ID NO: 11706 - DNA, 21 bp, Artificial Sequence
  Description of Artificial Sequence: Synthetic oligonucleotide
agcgactcctaggagtcgctc

SEQ ID NO: 11707 - DNA, 21 bp, Artificial Sequence
  Description of Artificial Sequence: Synthetic oligonucleotide
gacgactcctaggagtcgtcc

SEQ ID NO: 11708 - DNA, 21 bp, Artificial Sequence
  Description of Artificial Sequence: Synthetic oligonucleotide
ggagactcctaggagtctccc

SEQ ID NO: 11709 - DNA, 21 bp, Artificial Sequence
  Description of Artificial Sequence: Synthetic oligonucleotide
ggcgactcctaggagtcgcca

SEQ ID NO: 11710 - DNA, 21 bp, Artificial Sequence
  Description of Artificial Sequence: Synthetic oligonucleotide
tgcgactcctaggagtcgcac

SEQ ID NO: 11711 - DNA, 21 bp, Artificial Sequence
  Description of Artificial Sequence: Synthetic oligonucleotide
ggtgactcctaggagtcaccc

SEQ ID NO: 11712 - DNA, 21 bp, Artificial Sequence
  Description of Artificial Sequence: Synthetic oligonucleotide
cgggactcctaggagtcccgt

SEQ ID NO: 11713 - DNA, 21 bp, Artificial Sequence
  Description of Artificial Sequence: Synthetic oligonucleotide
agggactcctaggagtccctg

SEQ ID NO: 11714 - DNA, 21 bp, Artificial Sequence
  Description of Artificial Sequence: Synthetic oligonucleotide
caggactcctaggagtcctgg

SEQ ID NO: 11715 - DNA, 21 bp, Artificial Sequence
  Description of Artificial Sequence: Synthetic oligonucleotide
cgagactcctaggagtctcgg

SEQ ID NO: 11716 - DNA, 21 bp, Artificial Sequence
  Description of Artificial Sequence: Synthetic oligonucleotide
cgggactcctaggagtcccga

SEQ ID NO: 11717 - DNA, 21 bp, Artificial Sequence
  Description of Artificial Sequence: Synthetic oligonucleotide
tgggactcctaggagtcccag

SEQ ID NO: 11718 - DNA, 21 bp, Artificial Sequence
  Description of Artificial Sequence: Synthetic oligonucleotide
ctggactcctaggagtccagg

SEQ ID NO: 11719 - DNA, 21 bp, Artificial Sequence
  Description of Artificial Sequence: Synthetic oligonucleotide
cgtgactcctaggagtcacgg

SEQ ID NO: 11720 - DNA, 21 bp, Artificial Sequence
  Description of Artificial Sequence: Synthetic oligonucleotide
ggcgactcctaggagtcgccg

SEQ ID NO: 11721 - DNA, 21 bp, Artificial Sequence
  Description of Artificial Sequence: Synthetic oligonucleotide
agcgactcctaggagtcgctg

SEQ ID NO: 11722 - DNA, 21 bp, Artificial Sequence
  Description of Artificial Sequence: Synthetic oligonucleotide
gacgactcctaggagtcgtcg

SEQ ID NO: 11723 - DNA, 21 bp, Artificial Sequence
  Description of Artificial Sequence: Synthetic oligonucleotide
ggagactcctaggagtctccg

SEQ ID NO: 11724 - DNA, 21 bp, Artificial Sequence
  Description of Artificial Sequence: Synthetic oligonucleotide
tgcgactcctaggagtcgcag

SEQ ID NO: 11725 - DNA, 21 bp, Artificial Sequence
  Description of Artificial Sequence: Synthetic oligonucleotide
ggtgactcctaggagtcaccg

SEQ ID NO: 11726 - DNA, 21 bp, Artificial Sequence
  Description of Artificial Sequence: Synthetic oligonucleotide
acggactcctaggagtccgtg

SEQ ID NO: 11727 - DNA, 21 bp, Artificial Sequence
  Description of Artificial Sequence: Synthetic oligonucleotide
ccagactcctaggagtctggg

SEQ ID NO: 11728 - DNA, 21 bp, Artificial Sequence
  Description of Artificial Sequence: Synthetic oligonucleotide
tcggactcctaggagtccgag

SEQ ID NO: 11729 - DNA, 21 bp, Artificial Sequence
  Description of Artificial Sequence: Synthetic oligonucleotide
cctgactcctaggagtcaggg

SEQ ID NO: 11730 - DNA, 21 bp, Artificial Sequence
  Description of Artificial Sequence: Synthetic oligonucleotide
cacgactcctaggagtcgtgg

SEQ ID NO: 11731 - DNA, 21 bp, Artificial Sequence
  Description of Artificial Sequence: Synthetic oligonucleotide
gccgactcctaggagtcggct

SEQ ID NO: 11732 - DNA, 21 bp, Artificial Sequence
  Description of Artificial Sequence: Synthetic oligonucleotide
gccgactcctaggagtcggca

SEQ ID NO: 11733 - DNA, 21 bp, Artificial Sequence
  Description of Artificial Sequence: Synthetic oligonucleotide
cgagactcctaggagtctcgc

SEQ ID NO: 11734 - DNA, 21 bp, Artificial Sequence
  Description of Artificial Sequence: Synthetic oligonucleotide
cgtgactcctaggagtcacgc

SEQ ID NO: 11735 - DNA, 21 bp, Artificial Sequence
  Description of Artificial Sequence: Synthetic oligonucleotide
caggactcctaggagtcctgc

SEQ ID NO: 11736 - DNA, 21 bp, Artificial Sequence
  Description of Artificial Sequence: Synthetic oligonucleotide
ctggactcctaggagtccagc

SEQ ID NO: 11737 - DNA, 21 bp, Artificial Sequence
  Description of Artificial Sequence: Synthetic oligonucleotide
gaggactcctaggagtcctcg

SEQ ID NO: 11738 - DNA, 21 bp, Artificial Sequence
  Description of Artificial Sequence: Synthetic oligonucleotide
gtggactcctaggagtccacg

SEQ ID NO: 11739 - DNA, 21 bp, Artificial Sequence
  Description of Artificial Sequence: Synthetic oligonucleotide
accgactcctaggagtcggtg

SEQ ID NO: 11740 - DNA, 21 bp, Artificial Sequence
  Description of Artificial Sequence: Synthetic oligonucleotide
tccgactcctaggagtcggag

SEQ ID NO: 11741 - DNA, 21 bp, Artificial Sequence
  Description of Artificial Sequence: Synthetic oligonucleotide
cgggactcctaggagtcccgc

SEQ ID NO: 11742 - DNA, 21 bp, Artificial Sequence
  Description of Artificial Sequence: Synthetic oligonucleotide
agggactcctaggagtccctc

SEQ ID NO: 11743 - DNA, 21 bp, Artificial Sequence
  Description of Artificial Sequence: Synthetic oligonucleotide
tgggactcctaggagtcccac

SEQ ID NO: 11744 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactccatggagtcnnnn

SEQ ID NO: 11745 - DNA, 21 bp, Artificial Sequence
  Description of Artificial Sequence: Synthetic oligonucleotide
gcggactccatggagtccgcc

SEQ ID NO: 11746 - DNA, 21 bp, Artificial Sequence
  Description of Artificial Sequence: Synthetic oligonucleotide
gcggactccatggagtccgct

SEQ ID NO: 11747 - DNA, 21 bp, Artificial Sequence
  Description of Artificial Sequence: Synthetic oligonucleotide
acggactccatggagtccgtc

SEQ ID NO: 11748 - DNA, 21 bp, Artificial Sequence
  Description of Artificial Sequence: Synthetic oligonucleotide
gaggactccatggagtcctcc

SEQ ID NO: 11749 - DNA, 21 bp, Artificial Sequence
  Description of Artificial Sequence: Synthetic oligonucleotide
gcagactccatggagtctgcc

SEQ ID NO: 11750 - DNA, 21 bp, Artificial Sequence
  Description of Artificial Sequence: Synthetic oligonucleotide
gcggactccatggagtccgca

SEQ ID NO: 11751 - DNA, 21 bp, Artificial Sequence
  Description of Artificial Sequence: Synthetic oligonucleotide
tcggactccatggagtccgac

SEQ ID NO: 11752 - DNA, 21 bp, Artificial Sequence
  Description of Artificial Sequence: Synthetic oligonucleotide
gtggactccatggagtccacc

SEQ ID NO: 11753 - DNA, 21 bp, Artificial Sequence
  Description of Artificial Sequence: Synthetic oligonucleotide
gctgactccatggagtcagcc

SEQ ID NO: 11754 - DNA, 21 bp, Artificial Sequence
  Description of Artificial Sequence: Synthetic oligonucleotide
cccgactccatggagtcgggc

SEQ ID NO: 11755 - DNA, 21 bp, Artificial Sequence
  Description of Artificial Sequence: Synthetic oligonucleotide
cccgactccatggagtcgggt

SEQ ID NO: 11756 - DNA, 21 bp, Artificial Sequence
  Description of Artificial Sequence: Synthetic oligonucleotide
accgactccatggagtcggtc

SEQ ID NO: 11757 - DNA, 21 bp, Artificial Sequence
  Description of Artificial Sequence: Synthetic oligonucleotide
cacgactccatggagtcgtgc

SEQ ID NO: 11758 - DNA, 21 bp, Artificial Sequence
  Description of Artificial Sequence: Synthetic oligonucleotide
ccagactccatggagtctggc

SEQ ID NO: 11759 - DNA, 21 bp, Artificial Sequence
  Description of Artificial Sequence: Synthetic oligonucleotide
cccgactccatggagtcggga

SEQ ID NO: 11760 - DNA, 21 bp, Artificial Sequence
  Description of Artificial Sequence: Synthetic oligonucleotide
tccgactccatggagtcggac

SEQ ID NO: 11761 - DNA, 21 bp, Artificial Sequence
  Description of Artificial Sequence: Synthetic oligonucleotide
cctgactccatggagtcaggc

SEQ ID NO: 11762 - DNA, 21 bp, Artificial Sequence
  Description of Artificial Sequence: Synthetic oligonucleotide
ggcgactccatggagtcgccc

SEQ ID NO: 11763 - DNA, 21 bp, Artificial Sequence
  Description of Artificial Sequence: Synthetic oligonucleotide
ggcgactccatggagtcgcct

SEQ ID NO: 11764 - DNA, 21 bp, Artificial Sequence
  Description of Artificial Sequence: Synthetic oligonucleotide
agcgactccatggagtcgctc

SEQ ID NO: 11765 - DNA, 21 bp, Artificial Sequence
  Description of Artificial Sequence: Synthetic oligonucleotide
gacgactccatggagtcgtcc

SEQ ID NO: 11766 - DNA, 21 bp, Artificial Sequence
  Description of Artificial Sequence: Synthetic oligonucleotide
ggagactccatggagtctccc

SEQ ID NO: 11767 - DNA, 21 bp, Artificial Sequence
  Description of Artificial Sequence: Synthetic oligonucleotide
ggcgactccatggagtcgcca

SEQ ID NO: 11768 - DNA, 21 bp, Artificial Sequence
  Description of Artificial Sequence: Synthetic oligonucleotide
tgcgactccatggagtcgcac

SEQ ID NO: 11769 - DNA, 21 bp, Artificial Sequence
  Description of Artificial Sequence: Synthetic oligonucleotide
ggtgactccatggagtcaccc

SEQ ID NO: 11770 - DNA, 21 bp, Artificial Sequence
  Description of Artificial Sequence: Synthetic oligonucleotide
cgggactccatggagtcccgt

SEQ ID NO: 11771 - DNA, 21 bp, Artificial Sequence
  Description of Artificial Sequence: Synthetic oligonucleotide
agggactccatggagtccctg

SEQ ID NO: 11772 - DNA, 21 bp, Artificial Sequence
  Description of Artificial Sequence: Synthetic oligonucleotide
caggactccatggagtcctgg

SEQ ID NO: 11773 - DNA, 21 bp, Artificial Sequence
  Description of Artificial Sequence: Synthetic oligonucleotide
cgagactccatggagtctcgg

SEQ ID NO: 11774 - DNA, 21 bp, Artificial Sequence
  Description of Artificial Sequence: Synthetic oligonucleotide
cgggactccatggagtcccga

SEQ ID NO: 11775 - DNA, 21 bp, Artificial Sequence
  Description of Artificial Sequence: Synthetic oligonucleotide
tgggactccatggagtcccag

SEQ ID NO: 11776 - DNA, 21 bp, Artificial Sequence
  Description of Artificial Sequence: Synthetic oligonucleotide
ctggactccatggagtccagg

SEQ ID NO: 11777 - DNA, 21 bp, Artificial Sequence
  Description of Artificial Sequence: Synthetic oligonucleotide
cgtgactccatggagtcacgg

SEQ ID NO: 11778 - DNA, 21 bp, Artificial Sequence
  Description of Artificial Sequence: Synthetic oligonucleotide
ggcgactccatggagtcgccg

SEQ ID NO: 11779 - DNA, 21 bp, Artificial Sequence
  Description of Artificial Sequence: Synthetic oligonucleotide
agcgactccatggagtcgctg

SEQ ID NO: 11780 - DNA, 21 bp, Artificial Sequence
  Description of Artificial Sequence: Synthetic oligonucleotide
gacgactccatggagtcgtcg

SEQ ID NO: 11781 - DNA, 21 bp, Artificial Sequence
  Description of Artificial Sequence: Synthetic oligonucleotide
ggagactccatggagtctccg

SEQ ID NO: 11782 - DNA, 21 bp, Artificial Sequence
  Description of Artificial Sequence: Synthetic oligonucleotide
tgcgactccatggagtcgcag

SEQ ID NO: 11783 - DNA, 21 bp, Artificial Sequence
  Description of Artificial Sequence: Synthetic oligonucleotide
ggtgactccatggagtcaccg

SEQ ID NO: 11784 - DNA, 21 bp, Artificial Sequence
  Description of Artificial Sequence: Synthetic oligonucleotide
acggactccatggagtccgtg

SEQ ID NO: 11785 - DNA, 21 bp, Artificial Sequence
  Description of Artificial Sequence: Synthetic oligonucleotide
ccagactccatggagtctggg

SEQ ID NO: 11786 - DNA, 21 bp, Artificial Sequence
  Description of Artificial Sequence: Synthetic oligonucleotide
tcggactccatggagtccgag

SEQ ID NO: 11787 - DNA, 21 bp, Artificial Sequence
  Description of Artificial Sequence: Synthetic oligonucleotide
cctgactccatggagtcaggg

SEQ ID NO: 11788 - DNA, 21 bp, Artificial Sequence
  Description of Artificial Sequence: Synthetic oligonucleotide
cacgactccatggagtcgtgg

SEQ ID NO: 11789 - DNA, 21 bp, Artificial Sequence
  Description of Artificial Sequence: Synthetic oligonucleotide
gccgactccatggagtcggct

SEQ ID NO: 11790 - DNA, 21 bp, Artificial Sequence
  Description of Artificial Sequence: Synthetic oligonucleotide
gccgactccatggagtcggca

SEQ ID NO: 11791 - DNA, 21 bp, Artificial Sequence
  Description of Artificial Sequence: Synthetic oligonucleotide
cgagactccatggagtctcgc

SEQ ID NO: 11792 - DNA, 21 bp, Artificial Sequence
  Description of Artificial Sequence: Synthetic oligonucleotide
cgtgactccatggagtcacgc

SEQ ID NO: 11793 - DNA, 21 bp, Artificial Sequence
  Description of Artificial Sequence: Synthetic oligonucleotide
caggactccatggagtcctgc

SEQ ID NO: 11794 - DNA, 21 bp, Artificial Sequence
  Description of Artificial Sequence: Synthetic oligonucleotide
ctggactccatggagtccagc

SEQ ID NO: 11795 - DNA, 21 bp, Artificial Sequence
  Description of Artificial Sequence: Synthetic oligonucleotide
gaggactccatggagtcctcg

SEQ ID NO: 11796 - DNA, 21 bp, Artificial Sequence
  Description of Artificial Sequence: Synthetic oligonucleotide
gtggactccatggagtccacg

SEQ ID NO: 11797 - DNA, 21 bp, Artificial Sequence
  Description of Artificial Sequence: Synthetic oligonucleotide
accgactccatggagtcggtg

SEQ ID NO: 11798 - DNA, 21 bp, Artificial Sequence
  Description of Artificial Sequence: Synthetic oligonucleotide
tccgactccatggagtcggag

SEQ ID NO: 11799 - DNA, 21 bp, Artificial Sequence
  Description of Artificial Sequence: Synthetic oligonucleotide
cgggactccatggagtcccgc

SEQ ID NO: 11800 - DNA, 21 bp, Artificial Sequence
  Description of Artificial Sequence: Synthetic oligonucleotide
agggactccatggagtccctc

SEQ ID NO: 11801 - DNA, 21 bp, Artificial Sequence
  Description of Artificial Sequence: Synthetic oligonucleotide
tgggactccatggagtcccac

SEQ ID NO: 11802 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactctcgagagtcnnnn

SEQ ID NO: 11803 - DNA, 21 bp, Artificial Sequence
  Description of Artificial Sequence: Synthetic oligonucleotide
gcggactctcgagagtccgcc

SEQ ID NO: 11804 - DNA, 21 bp, Artificial Sequence
  Description of Artificial Sequence: Synthetic oligonucleotide
gcggactctcgagagtccgct

SEQ ID NO: 11805 - DNA, 21 bp, Artificial Sequence
  Description of Artificial Sequence: Synthetic oligonucleotide
acggactctcgagagtccgtc

SEQ ID NO: 11806 - DNA, 21 bp, Artificial Sequence
  Description of Artificial Sequence: Synthetic oligonucleotide
gaggactctcgagagtcctcc

SEQ ID NO: 11807 - DNA, 21 bp, Artificial Sequence
  Description of Artificial Sequence: Synthetic oligonucleotide
gcagactctcgagagtctgcc

SEQ ID NO: 11808 - DNA, 21 bp, Artificial Sequence
  Description of Artificial Sequence: Synthetic oligonucleotide
gcggactctcgagagtccgca

SEQ ID NO: 11809 - DNA, 21 bp, Artificial Sequence
  Description of Artificial Sequence: Synthetic oligonucleotide
tcggactctcgagagtccgac

SEQ ID NO: 11810 - DNA, 21 bp, Artificial Sequence
  Description of Artificial Sequence: Synthetic oligonucleotide
gtggactctcgagagtccacc

SEQ ID NO: 11811 - DNA, 21 bp, Artificial Sequence
  Description of Artificial Sequence: Synthetic oligonucleotide
gctgactctcgagagtcagcc

SEQ ID NO: 11812 - DNA, 21 bp, Artificial Sequence
  Description of Artificial Sequence: Synthetic oligonucleotide
cccgactctcgagagtcgggc

SEQ ID NO: 11813 - DNA, 21 bp, Artificial Sequence
  Description of Artificial Sequence: Synthetic oligonucleotide
cccgactctcgagagtcgggt

SEQ ID NO: 11814 - DNA, 21 bp, Artificial Sequence
  Description of Artificial Sequence: Synthetic oligonucleotide
accgactctcgagagtcggtc

SEQ ID NO: 11815 - DNA, 21 bp, Artificial Sequence
  Description of Artificial Sequence: Synthetic oligonucleotide
cacgactctcgagagtcgtgc

SEQ ID NO: 11816 - DNA, 21 bp, Artificial Sequence
  Description of Artificial Sequence: Synthetic oligonucleotide
ccagactctcgagagtctggc

SEQ ID NO: 11817 - DNA, 21 bp, Artificial Sequence
  Description of Artificial Sequence: Synthetic oligonucleotide
cccgactctcgagagtcggga

SEQ ID NO: 11818 - DNA, 21 bp, Artificial Sequence
  Description of Artificial Sequence: Synthetic oligonucleotide
tccgactctcgagagtcggac

SEQ ID NO: 11819 - DNA, 21 bp, Artificial Sequence
  Description of Artificial Sequence: Synthetic oligonucleotide
cctgactctcgagagtcaggc

SEQ ID NO: 11820 - DNA, 21 bp, Artificial Sequence
  Description of Artificial Sequence: Synthetic oligonucleotide
ggcgactctcgagagtcgccc

SEQ ID NO: 11821 - DNA, 21 bp, Artificial Sequence
  Description of Artificial Sequence: Synthetic oligonucleotide
ggcgactctcgagagtcgcct

SEQ ID NO: 11822 - DNA, 21 bp, Artificial Sequence
  Description of Artificial Sequence: Synthetic oligonucleotide
agcgactctcgagagtcgctc

SEQ ID NO: 11823 - DNA, 21 bp, Artificial Sequence
  Description of Artificial Sequence: Synthetic oligonucleotide
gacgactctcgagagtcgtcc

SEQ ID NO: 11824 - DNA, 21 bp, Artificial Sequence
  Description of Artificial Sequence: Synthetic oligonucleotide
ggagactctcgagagtctccc

SEQ ID NO: 11825 - DNA, 21 bp, Artificial Sequence
  Description of Artificial Sequence: Synthetic oligonucleotide
ggcgactctcgagagtcgcca

SEQ ID NO: 11826 - DNA, 21 bp, Artificial Sequence
  Description of Artificial Sequence: Synthetic oligonucleotide
tgcgactctcgagagtcgcac

SEQ ID NO: 11827 - DNA, 21 bp, Artificial Sequence
  Description of Artificial Sequence: Synthetic oligonucleotide
ggtgactctcgagagtcaccc

SEQ ID NO: 11828 - DNA, 21 bp, Artificial Sequence
  Description of Artificial Sequence: Synthetic oligonucleotide
cgggactctcgagagtcccgt

SEQ ID NO: 11829 - DNA, 21 bp, Artificial Sequence
  Description of Artificial Sequence: Synthetic oligonucleotide
agggactctcgagagtccctg

SEQ ID NO: 11830 - DNA, 21 bp, Artificial Sequence
  Description of Artificial Sequence: Synthetic oligonucleotide
caggactctcgagagtcctgg

SEQ ID NO: 11831 - DNA, 21 bp, Artificial Sequence
  Description of Artificial Sequence: Synthetic oligonucleotide
cgagactctcgagagtctcgg

SEQ ID NO: 11832 - DNA, 21 bp, Artificial Sequence
  Description of Artificial Sequence: Synthetic oligonucleotide
cgggactctcgagagtcccga

SEQ ID NO: 11833 - DNA, 21 bp, Artificial Sequence
  Description of Artificial Sequence: Synthetic oligonucleotide
tgggactctcgagagtcccag

SEQ ID NO: 11834 - DNA, 21 bp, Artificial Sequence
  Description of Artificial Sequence: Synthetic oligonucleotide
ctggactctcgagagtccagg

SEQ ID NO: 11835 - DNA, 21 bp, Artificial Sequence
  Description of Artificial Sequence: Synthetic oligonucleotide
cgtgactctcgagagtcacgg

SEQ ID NO: 11836 - DNA, 21 bp, Artificial Sequence
  Description of Artificial Sequence: Synthetic oligonucleotide
ggcgactctcgagagtcgccg

SEQ ID NO: 11837 - DNA, 21 bp, Artificial Sequence
  Description of Artificial Sequence: Synthetic oligonucleotide
agcgactctcgagagtcgctg

SEQ ID NO: 11838 - DNA, 21 bp, Artificial Sequence
  Description of Artificial Sequence: Synthetic oligonucleotide
gacgactctcgagagtcgtcg

SEQ ID NO: 11839 - DNA, 21 bp, Artificial Sequence
  Description of Artificial Sequence: Synthetic oligonucleotide
ggagactctcgagagtctccg

SEQ ID NO: 11840 - DNA, 21 bp, Artificial Sequence
  Description of Artificial Sequence: Synthetic oligonucleotide
tgcgactctcgagagtcgcag

SEQ ID NO: 11841 - DNA, 21 bp, Artificial Sequence
  Description of Artificial Sequence: Synthetic oligonucleotide
ggtgactctcgagagtcaccg

SEQ ID NO: 11842 - DNA, 21 bp, Artificial Sequence
  Description of Artificial Sequence: Synthetic oligonucleotide
acggactctcgagagtccgtg

SEQ ID NO: 11843 - DNA, 21 bp, Artificial Sequence
  Description of Artificial Sequence: Synthetic oligonucleotide
ccagactctcgagagtctggg

SEQ ID NO: 11844 - DNA, 21 bp, Artificial Sequence
  Description of Artificial Sequence: Synthetic oligonucleotide
tcggactctcgagagtccgag

SEQ ID NO: 11845 - DNA, 21 bp, Artificial Sequence
  Description of Artificial Sequence: Synthetic oligonucleotide
cctgactctcgagagtcaggg

SEQ ID NO: 11846 - DNA, 21 bp, Artificial Sequence
  Description of Artificial Sequence: Synthetic oligonucleotide
cacgactctcgagagtcgtgg

SEQ ID NO: 11847 - DNA, 21 bp, Artificial Sequence
  Description of Artificial Sequence: Synthetic oligonucleotide
gccgactctcgagagtcggct

SEQ ID NO: 11848 - DNA, 21 bp, Artificial Sequence
  Description of Artificial Sequence: Synthetic oligonucleotide
gccgactctcgagagtcggca

SEQ ID NO: 11849 - DNA, 21 bp, Artificial Sequence
  Description of Artificial Sequence: Synthetic oligonucleotide
cgagactctcgagagtctcgc

SEQ ID NO: 11850 - DNA, 21 bp, Artificial Sequence
  Description of Artificial Sequence: Synthetic oligonucleotide
cgtgactctcgagagtcacgc

SEQ ID NO: 11851 - DNA, 21 bp, Artificial Sequence
  Description of Artificial Sequence: Synthetic oligonucleotide
caggactctcgagagtcctgc

SEQ ID NO: 11852 - DNA, 21 bp, Artificial Sequence
  Description of Artificial Sequence: Synthetic oligonucleotide
ctggactctcgagagtccagc

SEQ ID NO: 11853 - DNA, 21 bp, Artificial Sequence
  Description of Artificial Sequence: Synthetic oligonucleotide
gaggactctcgagagtcctcg

SEQ ID NO: 11854 - DNA, 21 bp, Artificial Sequence
  Description of Artificial Sequence: Synthetic oligonucleotide
gtggactctcgagagtccacg

SEQ ID NO: 11855 - DNA, 21 bp, Artificial Sequence
  Description of Artificial Sequence: Synthetic oligonucleotide
accgactctcgagagtcggtg

SEQ ID NO: 11856 - DNA, 21 bp, Artificial Sequence
  Description of Artificial Sequence: Synthetic oligonucleotide
tccgactctcgagagtcggag

SEQ ID NO: 11857 - DNA, 21 bp, Artificial Sequence
  Description of Artificial Sequence: Synthetic oligonucleotide
cgggactctcgagagtcccgc

SEQ ID NO: 11858 - DNA, 21 bp, Artificial Sequence
  Description of Artificial Sequence: Synthetic oligonucleotide
agggactctcgagagtccctc

SEQ ID NO: 11859 - DNA, 21 bp, Artificial Sequence
  Description of Artificial Sequence: Synthetic oligonucleotide
tgggactctcgagagtcccac

SEQ ID NO: 11860 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcagctgagtcnnnn

SEQ ID NO: 11861 - DNA, 21 bp, Artificial Sequence
  Description of Artificial Sequence: Synthetic oligonucleotide
gcggactcagctgagtccgcc

SEQ ID NO: 11862 - DNA, 21 bp, Artificial Sequence
  Description of Artificial Sequence: Synthetic oligonucleotide
gcggactcagctgagtccgct

SEQ ID NO: 11863 - DNA, 21 bp, Artificial Sequence
  Description of Artificial Sequence: Synthetic oligonucleotide
acggactcagctgagtccgtc

SEQ ID NO: 11864 - DNA, 21 bp, Artificial Sequence
  Description of Artificial Sequence: Synthetic oligonucleotide
gaggactcagctgagtcctcc

SEQ ID NO: 11865 - DNA, 21 bp, Artificial Sequence
  Description of Artificial Sequence: Synthetic oligonucleotide
gcagactcagctgagtctgcc

SEQ ID NO: 11866 - DNA, 21 bp, Artificial Sequence
  Description of Artificial Sequence: Synthetic oligonucleotide
gcggactcagctgagtccgca

SEQ ID NO: 11867 - DNA, 21 bp, Artificial Sequence
  Description of Artificial Sequence: Synthetic oligonucleotide
tcggactcagctgagtccgac

SEQ ID NO: 11868 - DNA, 21 bp, Artificial Sequence
  Description of Artificial Sequence: Synthetic oligonucleotide
gtggactcagctgagtccacc

SEQ ID NO: 11869 - DNA, 21 bp, Artificial Sequence
  Description of Artificial Sequence: Synthetic oligonucleotide
gctgactcagctgagtcagcc

SEQ ID NO: 11870 - DNA, 21 bp, Artificial Sequence
  Description of Artificial Sequence: Synthetic oligonucleotide
cccgactcagctgagtcgggc

SEQ ID NO: 11871 - DNA, 21 bp, Artificial Sequence
  Description of Artificial Sequence: Synthetic oligonucleotide
cccgactcagctgagtcgggt

SEQ ID NO: 11872 - DNA, 21 bp, Artificial Sequence
  Description of Artificial Sequence: Synthetic oligonucleotide
accgactcagctgagtcggtc

SEQ ID NO: 11873 - DNA, 21 bp, Artificial Sequence
  Description of Artificial Sequence: Synthetic oligonucleotide
cacgactcagctgagtcgtgc

SEQ ID NO: 11874 - DNA, 21 bp, Artificial Sequence
  Description of Artificial Sequence: Synthetic oligonucleotide
ccagactcagctgagtctggc

SEQ ID NO: 11875 - DNA, 21 bp, Artificial Sequence
  Description of Artificial Sequence: Synthetic oligonucleotide
cccgactcagctgagtcggga

SEQ ID NO: 11876 - DNA, 21 bp, Artificial Sequence
  Description of Artificial Sequence: Synthetic oligonucleotide
tccgactcagctgagtcggac

SEQ ID NO: 11877 - DNA, 21 bp, Artificial Sequence
  Description of Artificial Sequence: Synthetic oligonucleotide
cctgactcagctgagtcaggc

SEQ ID NO: 11878 - DNA, 21 bp, Artificial Sequence
  Description of Artificial Sequence: Synthetic oligonucleotide
ggcgactcagctgagtcgccc

SEQ ID NO: 11879 - DNA, 21 bp, Artificial Sequence
  Description of Artificial Sequence: Synthetic oligonucleotide
ggcgactcagctgagtcgcct

SEQ ID NO: 11880 - DNA, 21 bp, Artificial Sequence
  Description of Artificial Sequence: Synthetic oligonucleotide
agcgactcagctgagtcgctc

SEQ ID NO: 11881 - DNA, 21 bp, Artificial Sequence
  Description of Artificial Sequence: Synthetic oligonucleotide
gacgactcagctgagtcgtcc

SEQ ID NO: 11882 - DNA, 21 bp, Artificial Sequence
  Description of Artificial Sequence: Synthetic oligonucleotide
ggagactcagctgagtctccc

SEQ ID NO: 11883 - DNA, 21 bp, Artificial Sequence
  Description of Artificial Sequence: Synthetic oligonucleotide
ggcgactcagctgagtcgcca

SEQ ID NO: 11884 - DNA, 21 bp, Artificial Sequence
  Description of Artificial Sequence: Synthetic oligonucleotide
tgcgactcagctgagtcgcac

SEQ ID NO: 11885 - DNA, 21 bp, Artificial Sequence
  Description of Artificial Sequence: Synthetic oligonucleotide
ggtgactcagctgagtcaccc

SEQ ID NO: 11886 - DNA, 21 bp, Artificial Sequence
  Description of Artificial Sequence: Synthetic oligonucleotide
cgggactcagctgagtcccgt

SEQ ID NO: 11887 - DNA, 21 bp, Artificial Sequence
  Description of Artificial Sequence: Synthetic oligonucleotide
agggactcagctgagtccctg

SEQ ID NO: 11888 - DNA, 21 bp, Artificial Sequence
  Description of Artificial Sequence: Synthetic oligonucleotide
caggactcagctgagtcctgg

SEQ ID NO: 11889 - DNA, 21 bp, Artificial Sequence
  Description of Artificial Sequence: Synthetic oligonucleotide
cgagactcagctgagtctcgg

SEQ ID NO: 11890 - DNA, 21 bp, Artificial Sequence
  Description of Artificial Sequence: Synthetic oligonucleotide
cgggactcagctgagtcccga

SEQ ID NO: 11891 - DNA, 21 bp, Artificial Sequence
  Description of Artificial Sequence: Synthetic oligonucleotide
tgggactcagctgagtcccag

SEQ ID NO: 11892 - DNA, 21 bp, Artificial Sequence
  Description of Artificial Sequence: Synthetic oligonucleotide
ctggactcagctgagtccagg

SEQ ID NO: 11893 - DNA, 21 bp, Artificial Sequence
  Description of Artificial Sequence: Synthetic oligonucleotide
cgtgactcagctgagtcacgg

SEQ ID NO: 11894 - DNA, 21 bp, Artificial Sequence
  Description of Artificial Sequence: Synthetic oligonucleotide
ggcgactcagctgagtcgccg

SEQ ID NO: 11895 - DNA, 21 bp, Artificial Sequence
  Description of Artificial Sequence: Synthetic oligonucleotide
agcgactcagctgagtcgctg

SEQ ID NO: 11896 - DNA, 21 bp, Artificial Sequence
  Description of Artificial Sequence: Synthetic oligonucleotide
gacgactcagctgagtcgtcg

SEQ ID NO: 11897 - DNA, 21 bp, Artificial Sequence
  Description of Artificial Sequence: Synthetic oligonucleotide
ggagactcagctgagtctccg

SEQ ID NO: 11898 - DNA, 21 bp, Artificial Sequence
  Description of Artificial Sequence: Synthetic oligonucleotide
tgcgactcagctgagtcgcag

SEQ ID NO: 11899 - DNA, 21 bp, Artificial Sequence
  Description of Artificial Sequence: Synthetic oligonucleotide
ggtgactcagctgagtcaccg

SEQ ID NO: 11900 - DNA, 21 bp, Artificial Sequence
  Description of Artificial Sequence: Synthetic oligonucleotide
acggactcagctgagtccgtg

SEQ ID NO: 11901 - DNA, 21 bp, Artificial Sequence
  Description of Artificial Sequence: Synthetic oligonucleotide
ccagactcagctgagtctggg

SEQ ID NO: 11902 - DNA, 21 bp, Artificial Sequence
  Description of Artificial Sequence: Synthetic oligonucleotide
tcggactcagctgagtccgag

SEQ ID NO: 11903 - DNA, 21 bp, Artificial Sequence
  Description of Artificial Sequence: Synthetic oligonucleotide
cctgactcagctgagtcaggg

SEQ ID NO: 11904 - DNA, 21 bp, Artificial Sequence
  Description of Artificial Sequence: Synthetic oligonucleotide
cacgactcagctgagtcgtgg

SEQ ID NO: 11905 - DNA, 21 bp, Artificial Sequence
  Description of Artificial Sequence: Synthetic oligonucleotide
gccgactcagctgagtcggct

SEQ ID NO: 11906 - DNA, 21 bp, Artificial Sequence
  Description of Artificial Sequence: Synthetic oligonucleotide
gccgactcagctgagtcggca

SEQ ID NO: 11907 - DNA, 21 bp, Artificial Sequence
  Description of Artificial Sequence: Synthetic oligonucleotide
cgagactcagctgagtctcgc

SEQ ID NO: 11908 - DNA, 21 bp, Artificial Sequence
  Description of Artificial Sequence: Synthetic oligonucleotide
cgtgactcagctgagtcacgc

SEQ ID NO: 11909 - DNA, 21 bp, Artificial Sequence
  Description of Artificial Sequence: Synthetic oligonucleotide
caggactcagctgagtcctgc

SEQ ID NO: 11910 - DNA, 21 bp, Artificial Sequence
  Description of Artificial Sequence: Synthetic oligonucleotide
ctggactcagctgagtccagc

SEQ ID NO: 11911 - DNA, 21 bp, Artificial Sequence
  Description of Artificial Sequence: Synthetic oligonucleotide
gaggactcagctgagtcctcg

SEQ ID NO: 11912 - DNA, 21 bp, Artificial Sequence
  Description of Artificial Sequence: Synthetic oligonucleotide
gtggactcagctgagtccacg

SEQ ID NO: 11913 - DNA, 21 bp, Artificial Sequence
  Description of Artificial Sequence: Synthetic oligonucleotide
accgactcagctgagtcggtg

SEQ ID NO: 11914 - DNA, 21 bp, Artificial Sequence
  Description of Artificial Sequence: Synthetic oligonucleotide
tccgactcagctgagtcggag

SEQ ID NO: 11915 - DNA, 21 bp, Artificial Sequence
  Description of Artificial Sequence: Synthetic oligonucleotide
cgggactcagctgagtcccgc

SEQ ID NO: 11916 - DNA, 21 bp, Artificial Sequence
  Description of Artificial Sequence: Synthetic oligonucleotide
agggactcagctgagtccctc

SEQ ID NO: 11917 - DNA, 21 bp, Artificial Sequence
  Description of Artificial Sequence: Synthetic oligonucleotide
tgggactcagctgagtcccac

SEQ ID NO: 11918 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcaattgagtcnnnn

SEQ ID NO: 11919 - DNA, 21 bp, Artificial Sequence
  Description of Artificial Sequence: Synthetic oligonucleotide
gcggactcaattgagtccgcc

SEQ ID NO: 11920 - DNA, 21 bp, Artificial Sequence
  Description of Artificial Sequence: Synthetic oligonucleotide
gcggactcaattgagtccgct

SEQ ID NO: 11921 - DNA, 21 bp, Artificial Sequence
  Description of Artificial Sequence: Synthetic oligonucleotide
acggactcaattgagtccgtc

SEQ ID NO: 11922 - DNA, 21 bp, Artificial Sequence
  Description of Artificial Sequence: Synthetic oligonucleotide
gaggactcaattgagtcctcc

SEQ ID NO: 11923 - DNA, 21 bp, Artificial Sequence
  Description of Artificial Sequence: Synthetic oligonucleotide
gcagactcaattgagtctgcc

SEQ ID NO: 11924 - DNA, 21 bp, Artificial Sequence
  Description of Artificial Sequence: Synthetic oligonucleotide
gcggactcaattgagtccgca

SEQ ID NO: 11925 - DNA, 21 bp, Artificial Sequence
  Description of Artificial Sequence: Synthetic oligonucleotide
tcggactcaattgagtccgac

SEQ ID NO: 11926 - DNA, 21 bp, Artificial Sequence
  Description of Artificial Sequence: Synthetic oligonucleotide
gtggactcaattgagtccacc

SEQ ID NO: 11927 - DNA, 21 bp, Artificial Sequence
  Description of Artificial Sequence: Synthetic oligonucleotide
gctgactcaattgagtcagcc

SEQ ID NO: 11928 - DNA, 21 bp, Artificial Sequence
  Description of Artificial Sequence: Synthetic oligonucleotide
cccgactcaattgagtcgggc

SEQ ID NO: 11929 - DNA, 21 bp, Artificial Sequence
  Description of Artificial Sequence: Synthetic oligonucleotide
cccgactcaattgagtcgggt

SEQ ID NO: 11930 - DNA, 21 bp, Artificial Sequence
  Description of Artificial Sequence: Synthetic oligonucleotide
accgactcaattgagtcggtc

SEQ ID NO: 11931 - DNA, 21 bp, Artificial Sequence
  Description of Artificial Sequence: Synthetic oligonucleotide
cacgactcaattgagtcgtgc

SEQ ID NO: 11932 - DNA, 21 bp, Artificial Sequence
  Description of Artificial Sequence: Synthetic oligonucleotide
ccagactcaattgagtctggc

SEQ ID NO: 11933 - DNA, 21 bp, Artificial Sequence
  Description of Artificial Sequence: Synthetic oligonucleotide
cccgactcaattgagtcggga

SEQ ID NO: 11934 - DNA, 21 bp, Artificial Sequence
  Description of Artificial Sequence: Synthetic oligonucleotide
tccgactcaattgagtcggac

SEQ ID NO: 11935 - DNA, 21 bp, Artificial Sequence
  Description of Artificial Sequence: Synthetic oligonucleotide
cctgactcaattgagtcaggc

SEQ ID NO: 11936 - DNA, 21 bp, Artificial Sequence
  Description of Artificial Sequence: Synthetic oligonucleotide
ggcgactcaattgagtcgccc

SEQ ID NO: 11937 - DNA, 21 bp, Artificial Sequence
  Description of Artificial Sequence: Synthetic oligonucleotide
ggcgactcaattgagtcgcct

SEQ ID NO: 11938 - DNA, 21 bp, Artificial Sequence
  Description of Artificial Sequence: Synthetic oligonucleotide
agcgactcaattgagtcgctc

SEQ ID NO: 11939 - DNA, 21 bp, Artificial Sequence
  Description of Artificial Sequence: Synthetic oligonucleotide
gacgactcaattgagtcgtcc

SEQ ID NO: 11940 - DNA, 21 bp, Artificial Sequence
  Description of Artificial Sequence: Synthetic oligonucleotide
ggagactcaattgagtctccc

SEQ ID NO: 11941 - DNA, 21 bp, Artificial Sequence
  Description of Artificial Sequence: Synthetic oligonucleotide
ggcgactcaattgagtcgcca

SEQ ID NO: 11942 - DNA, 21 bp, Artificial Sequence
  Description of Artificial Sequence: Synthetic oligonucleotide
tgcgactcaattgagtcgcac

SEQ ID NO: 11943 - DNA, 21 bp, Artificial Sequence
  Description of Artificial Sequence: Synthetic oligonucleotide
ggtgactcaattgagtcaccc

SEQ ID NO: 11944 - DNA, 21 bp, Artificial Sequence
  Description of Artificial Sequence: Synthetic oligonucleotide
cgggactcaattgagtcccgt

SEQ ID NO: 11945 - DNA, 21 bp, Artificial Sequence
  Description of Artificial Sequence: Synthetic oligonucleotide
agggactcaattgagtccctg

SEQ ID NO: 11946 - DNA, 21 bp, Artificial Sequence
  Description of Artificial Sequence: Synthetic oligonucleotide
caggactcaattgagtcctgg

SEQ ID NO: 11947 - DNA, 21 bp, Artificial Sequence
  Description of Artificial Sequence: Synthetic oligonucleotide
cgagactcaattgagtctcgg

SEQ ID NO: 11948 - DNA, 21 bp, Artificial Sequence
  Description of Artificial Sequence: Synthetic oligonucleotide
cgggactcaattgagtcccga

SEQ ID NO: 11949 - DNA, 21 bp, Artificial Sequence
  Description of Artificial Sequence: Synthetic oligonucleotide
tgggactcaattgagtcccag

SEQ ID NO: 11950 - DNA, 21 bp, Artificial Sequence
  Description of Artificial Sequence: Synthetic oligonucleotide
ctggactcaattgagtccagg

SEQ ID NO: 11951 - DNA, 21 bp, Artificial Sequence
  Description of Artificial Sequence: Synthetic oligonucleotide
cgtgactcaattgagtcacgg

SEQ ID NO: 11952 - DNA, 21 bp, Artificial Sequence
  Description of Artificial Sequence: Synthetic oligonucleotide
ggcgactcaattgagtcgccg

SEQ ID NO: 11953 - DNA, 21 bp, Artificial Sequence
  Description of Artificial Sequence: Synthetic oligonucleotide
agcgactcaattgagtcgctg

SEQ ID NO: 11954 - DNA, 21 bp, Artificial Sequence
  Description of Artificial Sequence: Synthetic oligonucleotide
gacgactcaattgagtcgtcg

SEQ ID NO: 11955 - DNA, 21 bp, Artificial Sequence
  Description of Artificial Sequence: Synthetic oligonucleotide
ggagactcaattgagtctccg

SEQ ID NO: 11956 - DNA, 21 bp, Artificial Sequence
  Description of Artificial Sequence: Synthetic oligonucleotide
tgcgactcaattgagtcgcag

SEQ ID NO: 11957 - DNA, 21 bp, Artificial Sequence
  Description of Artificial Sequence: Synthetic oligonucleotide
ggtgactcaattgagtcaccg

SEQ ID NO: 11958 - DNA, 21 bp, Artificial Sequence
  Description of Artificial Sequence: Synthetic oligonucleotide
acggactcaattgagtccgtg

SEQ ID NO: 11959 - DNA, 21 bp, Artificial Sequence
  Description of Artificial Sequence: Synthetic oligonucleotide
ccagactcaattgagtctggg

SEQ ID NO: 11960 - DNA, 21 bp, Artificial Sequence
  Description of Artificial Sequence: Synthetic oligonucleotide
tcggactcaattgagtccgag

SEQ ID NO: 11961 - DNA, 21 bp, Artificial Sequence
  Description of Artificial Sequence: Synthetic oligonucleotide
cctgactcaattgagtcaggg

SEQ ID NO: 11962 - DNA, 21 bp, Artificial Sequence
  Description of Artificial Sequence: Synthetic oligonucleotide
cacgactcaattgagtcgtgg

SEQ ID NO: 11963 - DNA, 21 bp, Artificial Sequence
  Description of Artificial Sequence: Synthetic oligonucleotide
gccgactcaattgagtcggct

SEQ ID NO: 11964 - DNA, 21 bp, Artificial Sequence
  Description of Artificial Sequence: Synthetic oligonucleotide
gccgactcaattgagtcggca

SEQ ID NO: 11965 - DNA, 21 bp, Artificial Sequence
  Description of Artificial Sequence: Synthetic oligonucleotide
cgagactcaattgagtctcgc

SEQ ID NO: 11966 - DNA, 21 bp, Artificial Sequence
  Description of Artificial Sequence: Synthetic oligonucleotide
cgtgactcaattgagtcacgc

SEQ ID NO: 11967 - DNA, 21 bp, Artificial Sequence
  Description of Artificial Sequence: Synthetic oligonucleotide
caggactcaattgagtcctgc

SEQ ID NO: 11968 - DNA, 21 bp, Artificial Sequence
  Description of Artificial Sequence: Synthetic oligonucleotide
ctggactcaattgagtccagc

SEQ ID NO: 11969 - DNA, 21 bp, Artificial Sequence
  Description of Artificial Sequence: Synthetic oligonucleotide
gaggactcaattgagtcctcg

SEQ ID NO: 11970 - DNA, 21 bp, Artificial Sequence
  Description of Artificial Sequence: Synthetic oligonucleotide
gtggactcaattgagtccacg

SEQ ID NO: 11971 - DNA, 21 bp, Artificial Sequence
  Description of Artificial Sequence: Synthetic oligonucleotide
accgactcaattgagtcggtg

SEQ ID NO: 11972 - DNA, 21 bp, Artificial Sequence
  Description of Artificial Sequence: Synthetic oligonucleotide
tccgactcaattgagtcggag

SEQ ID NO: 11973 - DNA, 21 bp, Artificial Sequence
  Description of Artificial Sequence: Synthetic oligonucleotide
cgggactcaattgagtcccgc

SEQ ID NO: 11974 - DNA, 21 bp, Artificial Sequence
  Description of Artificial Sequence: Synthetic oligonucleotide
agggactcaattgagtccctc

SEQ ID NO: 11975 - DNA, 21 bp, Artificial Sequence
  Description of Artificial Sequence: Synthetic oligonucleotide
tgggactcaattgagtcccac

SEQ ID NO: 11976 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactctatagagtcnnnn

SEQ ID NO: 11977 - DNA, 21 bp, Artificial Sequence
  Description of Artificial Sequence: Synthetic oligonucleotide
gcggactctatagagtccgcc

SEQ ID NO: 11978 - DNA, 21 bp, Artificial Sequence
  Description of Artificial Sequence: Synthetic oligonucleotide
gcggactctatagagtccgct

SEQ ID NO: 11979 - DNA, 21 bp, Artificial Sequence
  Description of Artificial Sequence: Synthetic oligonucleotide
acggactctatagagtccgtc

SEQ ID NO: 11980 - DNA, 21 bp, Artificial Sequence
  Description of Artificial Sequence: Synthetic oligonucleotide
gaggactctatagagtcctcc

SEQ ID NO: 11981 - DNA, 21 bp, Artificial Sequence
  Description of Artificial Sequence: Synthetic oligonucleotide
gcagactctatagagtctgcc

SEQ ID NO: 11982 - DNA, 21 bp, Artificial Sequence
  Description of Artificial Sequence: Synthetic oligonucleotide
gcggactctatagagtccgca

SEQ ID NO: 11983 - DNA, 21 bp, Artificial Sequence
  Description of Artificial Sequence: Synthetic oligonucleotide
tcggactctatagagtccgac

SEQ ID NO: 11984 - DNA, 21 bp, Artificial Sequence
  Description of Artificial Sequence: Synthetic oligonucleotide
gtggactctatagagtccacc

SEQ ID NO: 11985 - DNA, 21 bp, Artificial Sequence
  Description of Artificial Sequence: Synthetic oligonucleotide
gctgactctatagagtcagcc

SEQ ID NO: 11986 - DNA, 21 bp, Artificial Sequence
  Description of Artificial Sequence: Synthetic oligonucleotide
cccgactctatagagtcgggc

SEQ ID NO: 11987 - DNA, 21 bp, Artificial Sequence
  Description of Artificial Sequence: Synthetic oligonucleotide
cccgactctatagagtcgggt

SEQ ID NO: 11988 - DNA, 21 bp, Artificial Sequence
  Description of Artificial Sequence: Synthetic oligonucleotide
accgactctatagagtcggtc

SEQ ID NO: 11989 - DNA, 21 bp, Artificial Sequence
  Description of Artificial Sequence: Synthetic oligonucleotide
cacgactctatagagtcgtgc

SEQ ID NO: 11990 - DNA, 21 bp, Artificial Sequence
  Description of Artificial Sequence: Synthetic oligonucleotide
ccagactctatagagtctggc

SEQ ID NO: 11991 - DNA, 21 bp, Artificial Sequence
  Description of Artificial Sequence: Synthetic oligonucleotide
cccgactctatagagtcggga

SEQ ID NO: 11992 - DNA, 21 bp, Artificial Sequence
  Description of Artificial Sequence: Synthetic oligonucleotide
tccgactctatagagtcggac

SEQ ID NO: 11993 - DNA, 21 bp, Artificial Sequence
  Description of Artificial Sequence: Synthetic oligonucleotide
cctgactctatagagtcaggc

SEQ ID NO: 11994 - DNA, 21 bp, Artificial Sequence
  Description of Artificial Sequence: Synthetic oligonucleotide
ggcgactctatagagtcgccc

SEQ ID NO: 11995 - DNA, 21 bp, Artificial Sequence
  Description of Artificial Sequence: Synthetic oligonucleotide
ggcgactctatagagtcgcct

SEQ ID NO: 11996 - DNA, 21 bp, Artificial Sequence
  Description of Artificial Sequence: Synthetic oligonucleotide
agcgactctatagagtcgctc

SEQ ID NO: 11997 - DNA, 21 bp, Artificial Sequence
  Description of Artificial Sequence: Synthetic oligonucleotide
gacgactctatagagtcgtcc

SEQ ID NO: 11998 - DNA, 21 bp, Artificial Sequence
  Description of Artificial Sequence: Synthetic oligonucleotide
ggagactctatagagtctccc

SEQ ID NO: 11999 - DNA, 21 bp, Artificial Sequence
  Description of Artificial Sequence: Synthetic oligonucleotide
ggcgactctatagagtcgcca

SEQ ID NO: 12000 - DNA, 21 bp, Artificial Sequence
  Description of Artificial Sequence: Synthetic oligonucleotide
tgcgactctatagagtcgcac

SEQ ID NO: 12001 - DNA, 21 bp, Artificial Sequence
  Description of Artificial Sequence: Synthetic oligonucleotide
ggtgactctatagagtcaccc

SEQ ID NO: 12002 - DNA, 21 bp, Artificial Sequence
  Description of Artificial Sequence: Synthetic oligonucleotide
cgggactctatagagtcccgt

SEQ ID NO: 12003 - DNA, 21 bp, Artificial Sequence
  Description of Artificial Sequence: Synthetic oligonucleotide
agggactctatagagtccctg

SEQ ID NO: 12004 - DNA, 21 bp, Artificial Sequence
  Description of Artificial Sequence: Synthetic oligonucleotide
caggactctatagagtcctgg

SEQ ID NO: 12005 - DNA, 21 bp, Artificial Sequence
  Description of Artificial Sequence: Synthetic oligonucleotide
cgagactctatagagtctcgg

SEQ ID NO: 12006 - DNA, 21 bp, Artificial Sequence
  Description of Artificial Sequence: Synthetic oligonucleotide
cgggactctatagagtcccga

SEQ ID NO: 12007 - DNA, 21 bp, Artificial Sequence
  Description of Artificial Sequence: Synthetic oligonucleotide
tgggactctatagagtcccag

SEQ ID NO: 12008 - DNA, 21 bp, Artificial Sequence
  Description of Artificial Sequence: Synthetic oligonucleotide
ctggactctatagagtccagg

SEQ ID NO: 12009 - DNA, 21 bp, Artificial Sequence
  Description of Artificial Sequence: Synthetic oligonucleotide
cgtgactctatagagtcacgg

SEQ ID NO: 12010 - DNA, 21 bp, Artificial Sequence
  Description of Artificial Sequence: Synthetic oligonucleotide
ggcgactctatagagtcgccg

SEQ ID NO: 12011 - DNA, 21 bp, Artificial Sequence
  Description of Artificial Sequence: Synthetic oligonucleotide
agcgactctatagagtcgctg

SEQ ID NO: 12012 - DNA, 21 bp, Artificial Sequence
  Description of Artificial Sequence: Synthetic oligonucleotide
gacgactctatagagtcgtcg

SEQ ID NO: 12013 - DNA, 21 bp, Artificial Sequence
  Description of Artificial Sequence: Synthetic oligonucleotide
ggagactctatagagtctccg

SEQ ID NO: 12014 - DNA, 21 bp, Artificial Sequence
  Description of Artificial Sequence: Synthetic oligonucleotide
tgcgactctatagagtcgcag

SEQ ID NO: 12015 - DNA, 21 bp, Artificial Sequence
  Description of Artificial Sequence: Synthetic oligonucleotide
ggtgactctatagagtcaccg

SEQ ID NO: 12016 - DNA, 21 bp, Artificial Sequence
  Description of Artificial Sequence: Synthetic oligonucleotide
acggactctatagagtccgtg

SEQ ID NO: 12017 - DNA, 21 bp, Artificial Sequence
  Description of Artificial Sequence: Synthetic oligonucleotide
ccagactctatagagtctggg

SEQ ID NO: 12018 - DNA, 21 bp, Artificial Sequence
  Description of Artificial Sequence: Synthetic oligonucleotide
tcggactctatagagtccgag

SEQ ID NO: 12019 - DNA, 21 bp, Artificial Sequence
  Description of Artificial Sequence: Synthetic oligonucleotide
cctgactctatagagtcaggg

SEQ ID NO: 12020 - DNA, 21 bp, Artificial Sequence
  Description of Artificial Sequence: Synthetic oligonucleotide
cacgactctatagagtcgtgg

SEQ ID NO: 12021 - DNA, 21 bp, Artificial Sequence
  Description of Artificial Sequence: Synthetic oligonucleotide
gccgactctatagagtcggct

SEQ ID NO: 12022 - DNA, 21 bp, Artificial Sequence
  Description of Artificial Sequence: Synthetic oligonucleotide
gccgactctatagagtcggca

SEQ ID NO: 12023 - DNA, 21 bp, Artificial Sequence
  Description of Artificial Sequence: Synthetic oligonucleotide
cgagactctatagagtctcgc

SEQ ID NO: 12024 - DNA, 21 bp, Artificial Sequence
  Description of Artificial Sequence: Synthetic oligonucleotide
cgtgactctatagagtcacgc

SEQ ID NO: 12025 - DNA, 21 bp, Artificial Sequence
  Description of Artificial Sequence: Synthetic oligonucleotide
caggactctatagagtcctgc

SEQ ID NO: 12026 - DNA, 21 bp, Artificial Sequence
  Description of Artificial Sequence: Synthetic oligonucleotide
ctggactctatagagtccagc

SEQ ID NO: 12027 - DNA, 21 bp, Artificial Sequence
  Description of Artificial Sequence: Synthetic oligonucleotide
gaggactctatagagtcctcg

SEQ ID NO: 12028 - DNA, 21 bp, Artificial Sequence
  Description of Artificial Sequence: Synthetic oligonucleotide
gtggactctatagagtccacg

SEQ ID NO: 12029 - DNA, 21 bp, Artificial Sequence
  Description of Artificial Sequence: Synthetic oligonucleotide
accgactctatagagtcggtg

SEQ ID NO: 12030 - DNA, 21 bp, Artificial Sequence
  Description of Artificial Sequence: Synthetic oligonucleotide
tccgactctatagagtcggag

SEQ ID NO: 12031 - DNA, 21 bp, Artificial Sequence
  Description of Artificial Sequence: Synthetic oligonucleotide
cgggactctatagagtcccgc

SEQ ID NO: 12032 - DNA, 21 bp, Artificial Sequence
  Description of Artificial Sequence: Synthetic oligonucleotide
agggactctatagagtccctc

SEQ ID NO: 12033 - DNA, 21 bp, Artificial Sequence
  Description of Artificial Sequence: Synthetic oligonucleotide
tgggactctatagagtcccac

SEQ ID NO: 12034 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcatatgagtcnnnn

SEQ ID NO: 12035 - DNA, 21 bp, Artificial Sequence
  Description of Artificial Sequence: Synthetic oligonucleotide
gcggactcatatgagtccgcc

SEQ ID NO: 12036 - DNA, 21 bp, Artificial Sequence
  Description of Artificial Sequence: Synthetic oligonucleotide
gcggactcatatgagtccgct

SEQ ID NO: 12037 - DNA, 21 bp, Artificial Sequence
  Description of Artificial Sequence: Synthetic oligonucleotide
acggactcatatgagtccgtc

SEQ ID NO: 12038 - DNA, 21 bp, Artificial Sequence
  Description of Artificial Sequence: Synthetic oligonucleotide
gaggactcatatgagtcctcc

SEQ ID NO: 12039 - DNA, 21 bp, Artificial Sequence
  Description of Artificial Sequence: Synthetic oligonucleotide
gcagactcatatgagtctgcc

SEQ ID NO: 12040 - DNA, 21 bp, Artificial Sequence
  Description of Artificial Sequence: Synthetic oligonucleotide
gcggactcatatgagtccgca

SEQ ID NO: 12041 - DNA, 21 bp, Artificial Sequence
  Description of Artificial Sequence: Synthetic oligonucleotide
tcggactcatatgagtccgac

SEQ ID NO: 12042 - DNA, 21 bp, Artificial Sequence
  Description of Artificial Sequence: Synthetic oligonucleotide
gtggactcatatgagtccacc

SEQ ID NO: 12043 - DNA, 21 bp, Artificial Sequence
  Description of Artificial Sequence: Synthetic oligonucleotide
gctgactcatatgagtcagcc

SEQ ID NO: 12044 - DNA, 21 bp, Artificial Sequence
  Description of Artificial Sequence: Synthetic oligonucleotide
cccgactcatatgagtcgggc

SEQ ID NO: 12045 - DNA, 21 bp, Artificial Sequence
  Description of Artificial Sequence: Synthetic oligonucleotide
cccgactcatatgagtcgggt

SEQ ID NO: 12046 - DNA, 21 bp, Artificial Sequence
  Description of Artificial Sequence: Synthetic oligonucleotide
accgactcatatgagtcggtc

SEQ ID NO: 12047 - DNA, 21 bp, Artificial Sequence
  Description of Artificial Sequence: Synthetic oligonucleotide
cacgactcatatgagtcgtgc

SEQ ID NO: 12048 - DNA, 21 bp, Artificial Sequence
  Description of Artificial Sequence: Synthetic oligonucleotide
ccagactcatatgagtctggc

SEQ ID NO: 12049 - DNA, 21 bp, Artificial Sequence
  Description of Artificial Sequence: Synthetic oligonucleotide
cccgactcatatgagtcggga

SEQ ID NO: 12050 - DNA, 21 bp, Artificial Sequence
  Description of Artificial Sequence: Synthetic oligonucleotide
tccgactcatatgagtcggac

SEQ ID NO: 12051 - DNA, 21 bp, Artificial Sequence
  Description of Artificial Sequence: Synthetic oligonucleotide
cctgactcatatgagtcaggc

SEQ ID NO: 12052 - DNA, 21 bp, Artificial Sequence
  Description of Artificial Sequence: Synthetic oligonucleotide
ggcgactcatatgagtcgccc

SEQ ID NO: 12053 - DNA, 21 bp, Artificial Sequence
  Description of Artificial Sequence: Synthetic oligonucleotide
ggcgactcatatgagtcgcct

SEQ ID NO: 12054 - DNA, 21 bp, Artificial Sequence
  Description of Artificial Sequence: Synthetic oligonucleotide
agcgactcatatgagtcgctc

SEQ ID NO: 12055 - DNA, 21 bp, Artificial Sequence
  Description of Artificial Sequence: Synthetic oligonucleotide
gacgactcatatgagtcgtcc

SEQ ID NO: 12056 - DNA, 21 bp, Artificial Sequence
  Description of Artificial Sequence: Synthetic oligonucleotide
ggagactcatatgagtctccc

SEQ ID NO: 12057 - DNA, 21 bp, Artificial Sequence
  Description of Artificial Sequence: Synthetic oligonucleotide
ggcgactcatatgagtcgcca

SEQ ID NO: 12058 - DNA, 21 bp, Artificial Sequence
  Description of Artificial Sequence: Synthetic oligonucleotide
tgcgactcatatgagtcgcac

SEQ ID NO: 12059 - DNA, 21 bp, Artificial Sequence
  Description of Artificial Sequence: Synthetic oligonucleotide
ggtgactcatatgagtcaccc

SEQ ID NO: 12060 - DNA, 21 bp, Artificial Sequence
  Description of Artificial Sequence: Synthetic oligonucleotide
cgggactcatatgagtcccgt

SEQ ID NO: 12061 - DNA, 21 bp, Artificial Sequence
  Description of Artificial Sequence: Synthetic oligonucleotide
agggactcatatgagtccctg

SEQ ID NO: 12062 - DNA, 21 bp, Artificial Sequence
  Description of Artificial Sequence: Synthetic oligonucleotide
caggactcatatgagtcctgg

SEQ ID NO: 12063 - DNA, 21 bp, Artificial Sequence
  Description of Artificial Sequence: Synthetic oligonucleotide
cgagactcatatgagtctcgg

SEQ ID NO: 12064 - DNA, 21 bp, Artificial Sequence
  Description of Artificial Sequence: Synthetic oligonucleotide
cgggactcatatgagtcccga

SEQ ID NO: 12065 - DNA, 21 bp, Artificial Sequence
  Description of Artificial Sequence: Synthetic oligonucleotide
tgggactcatatgagtcccag

SEQ ID NO: 12066 - DNA, 21 bp, Artificial Sequence
  Description of Artificial Sequence: Synthetic oligonucleotide
ctggactcatatgagtccagg

SEQ ID NO: 12067 - DNA, 21 bp, Artificial Sequence
  Description of Artificial Sequence: Synthetic oligonucleotide
cgtgactcatatgagtcacgg

SEQ ID NO: 12068 - DNA, 21 bp, Artificial Sequence
  Description of Artificial Sequence: Synthetic oligonucleotide
ggcgactcatatgagtcgccg

SEQ ID NO: 12069 - DNA, 21 bp, Artificial Sequence
  Description of Artificial Sequence: Synthetic oligonucleotide
agcgactcatatgagtcgctg

SEQ ID NO: 12070 - DNA, 21 bp, Artificial Sequence
  Description of Artificial Sequence: Synthetic oligonucleotide
gacgactcatatgagtcgtcg

SEQ ID NO: 12071 - DNA, 21 bp, Artificial Sequence
  Description of Artificial Sequence: Synthetic oligonucleotide
ggagactcatatgagtctccg

SEQ ID NO: 12072 - DNA, 21 bp, Artificial Sequence
  Description of Artificial Sequence: Synthetic oligonucleotide
tgcgactcatatgagtcgcag

SEQ ID NO: 12073 - DNA, 21 bp, Artificial Sequence
  Description of Artificial Sequence: Synthetic oligonucleotide
ggtgactcatatgagtcaccg

SEQ ID NO: 12074 - DNA, 21 bp, Artificial Sequence
  Description of Artificial Sequence: Synthetic oligonucleotide
acggactcatatgagtccgtg

SEQ ID NO: 12075 - DNA, 21 bp, Artificial Sequence
  Description of Artificial Sequence: Synthetic oligonucleotide
ccagactcatatgagtctggg

SEQ ID NO: 12076 - DNA, 21 bp, Artificial Sequence
  Description of Artificial Sequence: Synthetic oligonucleotide
tcggactcatatgagtccgag

SEQ ID NO: 12077 - DNA, 21 bp, Artificial Sequence
  Description of Artificial Sequence: Synthetic oligonucleotide
cctgactcatatgagtcaggg

SEQ ID NO: 12078 - DNA, 21 bp, Artificial Sequence
  Description of Artificial Sequence: Synthetic oligonucleotide
cacgactcatatgagtcgtgg

SEQ ID NO: 12079 - DNA, 21 bp, Artificial Sequence
  Description of Artificial Sequence: Synthetic oligonucleotide
gccgactcatatgagtcggct

SEQ ID NO: 12080 - DNA, 21 bp, Artificial Sequence
  Description of Artificial Sequence: Synthetic oligonucleotide
gccgactcatatgagtcggca

SEQ ID NO: 12081 - DNA, 21 bp, Artificial Sequence
  Description of Artificial Sequence: Synthetic oligonucleotide
cgagactcatatgagtctcgc

SEQ ID NO: 12082 - DNA, 21 bp, Artificial Sequence
  Description of Artificial Sequence: Synthetic oligonucleotide
cgtgactcatatgagtcacgc

SEQ ID NO: 12083 - DNA, 21 bp, Artificial Sequence
  Description of Artificial Sequence: Synthetic oligonucleotide
caggactcatatgagtcctgc

SEQ ID NO: 12084 - DNA, 21 bp, Artificial Sequence
  Description of Artificial Sequence: Synthetic oligonucleotide
ctggactcatatgagtccagc

SEQ ID NO: 12085 - DNA, 21 bp, Artificial Sequence
  Description of Artificial Sequence: Synthetic oligonucleotide
gaggactcatatgagtcctcg

SEQ ID NO: 12086 - DNA, 21 bp, Artificial Sequence
  Description of Artificial Sequence: Synthetic oligonucleotide
gtggactcatatgagtccacg

SEQ ID NO: 12087 - DNA, 21 bp, Artificial Sequence
  Description of Artificial Sequence: Synthetic oligonucleotide
accgactcatatgagtcggtg

SEQ ID NO: 12088 - DNA, 21 bp, Artificial Sequence
  Description of Artificial Sequence: Synthetic oligonucleotide
tccgactcatatgagtcggag

SEQ ID NO: 12089 - DNA, 21 bp, Artificial Sequence
  Description of Artificial Sequence: Synthetic oligonucleotide
cgggactcatatgagtcccgc

SEQ ID NO: 12090 - DNA, 21 bp, Artificial Sequence
  Description of Artificial Sequence: Synthetic oligonucleotide
agggactcatatgagtccctc

SEQ ID NO: 12091 - DNA, 21 bp, Artificial Sequence
  Description of Artificial Sequence: Synthetic oligonucleotide
tgggactcatatgagtcccac

SEQ ID NO: 12092 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcttaagagtcnnnn

SEQ ID NO: 12093 - DNA, 21 bp, Artificial Sequence
  Description of Artificial Sequence: Synthetic oligonucleotide
gcggactcttaagagtccgcc

SEQ ID NO: 12094 - DNA, 21 bp, Artificial Sequence
  Description of Artificial Sequence: Synthetic oligonucleotide
gcggactcttaagagtccgct

SEQ ID NO: 12095 - DNA, 21 bp, Artificial Sequence
  Description of Artificial Sequence: Synthetic oligonucleotide
acggactcttaagagtccgtc

SEQ ID NO: 12096 - DNA, 21 bp, Artificial Sequence
  Description of Artificial Sequence: Synthetic oligonucleotide
gaggactcttaagagtcctcc

SEQ ID NO: 12097 - DNA, 21 bp, Artificial Sequence
  Description of Artificial Sequence: Synthetic oligonucleotide
gcagactcttaagagtctgcc

SEQ ID NO: 12098 - DNA, 21 bp, Artificial Sequence
  Description of Artificial Sequence: Synthetic oligonucleotide
gcggactcttaagagtccgca

SEQ ID NO: 12099 - DNA, 21 bp, Artificial Sequence
  Description of Artificial Sequence: Synthetic oligonucleotide
tcggactcttaagagtccgac

SEQ ID NO: 12100 - DNA, 21 bp, Artificial Sequence
  Description of Artificial Sequence: Synthetic oligonucleotide
gtggactcttaagagtccacc

SEQ ID NO: 12101 - DNA, 21 bp, Artificial Sequence
  Description of Artificial Sequence: Synthetic oligonucleotide
gctgactcttaagagtcagcc

SEQ ID NO: 12102 - DNA, 21 bp, Artificial Sequence
  Description of Artificial Sequence: Synthetic oligonucleotide
cccgactcttaagagtcgggc

SEQ ID NO: 12103 - DNA, 21 bp, Artificial Sequence
  Description of Artificial Sequence: Synthetic oligonucleotide
cccgactcttaagagtcgggt

SEQ ID NO: 12104 - DNA, 21 bp, Artificial Sequence
  Description of Artificial Sequence: Synthetic oligonucleotide
accgactcttaagagtcggtc

SEQ ID NO: 12105 - DNA, 21 bp, Artificial Sequence
  Description of Artificial Sequence: Synthetic oligonucleotide
cacgactcttaagagtcgtgc

SEQ ID NO: 12106 - DNA, 21 bp, Artificial Sequence
  Description of Artificial Sequence: Synthetic oligonucleotide
ccagactcttaagagtctggc

SEQ ID NO: 12107 - DNA, 21 bp, Artificial Sequence
  Description of Artificial Sequence: Synthetic oligonucleotide
cccgactcttaagagtcggga

SEQ ID NO: 12108 - DNA, 21 bp, Artificial Sequence
  Description of Artificial Sequence: Synthetic oligonucleotide
tccgactcttaagagtcggac

SEQ ID NO: 12109 - DNA, 21 bp, Artificial Sequence
  Description of Artificial Sequence: Synthetic oligonucleotide
cctgactcttaagagtcaggc

SEQ ID NO: 12110 - DNA, 21 bp, Artificial Sequence
  Description of Artificial Sequence: Synthetic oligonucleotide
ggcgactcttaagagtcgccc

SEQ ID NO: 12111 - DNA, 21 bp, Artificial Sequence
  Description of Artificial Sequence: Synthetic oligonucleotide
ggcgactcttaagagtcgcct

SEQ ID NO: 12112 - DNA, 21 bp, Artificial Sequence
  Description of Artificial Sequence: Synthetic oligonucleotide
agcgactcttaagagtcgctc

SEQ ID NO: 12113 - DNA, 21 bp, Artificial Sequence
  Description of Artificial Sequence: Synthetic oligonucleotide
gacgactcttaagagtcgtcc

SEQ ID NO: 12114 - DNA, 21 bp, Artificial Sequence
  Description of Artificial Sequence: Synthetic oligonucleotide
ggagactcttaagagtctccc

SEQ ID NO: 12115 - DNA, 21 bp, Artificial Sequence
  Description of Artificial Sequence: Synthetic oligonucleotide
ggcgactcttaagagtcgcca

SEQ ID NO: 12116 - DNA, 21 bp, Artificial Sequence
  Description of Artificial Sequence: Synthetic oligonucleotide
tgcgactcttaagagtcgcac

SEQ ID NO: 12117 - DNA, 21 bp, Artificial Sequence
  Description of Artificial Sequence: Synthetic oligonucleotide
ggtgactcttaagagtcaccc

SEQ ID NO: 12118 - DNA, 21 bp, Artificial Sequence
  Description of Artificial Sequence: Synthetic oligonucleotide
cgggactcttaagagtcccgt

SEQ ID NO: 12119 - DNA, 21 bp, Artificial Sequence
  Description of Artificial Sequence: Synthetic oligonucleotide
agggactcttaagagtccctg

SEQ ID NO: 12120 - DNA, 21 bp, Artificial Sequence
  Description of Artificial Sequence: Synthetic oligonucleotide
caggactcttaagagtcctgg

SEQ ID NO: 12121 - DNA, 21 bp, Artificial Sequence
  Description of Artificial Sequence: Synthetic oligonucleotide
cgagactcttaagagtctcgg

SEQ ID NO: 12122 - DNA, 21 bp, Artificial Sequence
  Description of Artificial Sequence: Synthetic oligonucleotide
cgggactcttaagagtcccga

SEQ ID NO: 12123 - DNA, 21 bp, Artificial Sequence
  Description of Artificial Sequence: Synthetic oligonucleotide
tgggactcttaagagtcccag

SEQ ID NO: 12124 - DNA, 21 bp, Artificial Sequence
  Description of Artificial Sequence: Synthetic oligonucleotide
ctggactcttaagagtccagg

SEQ ID NO: 12125 - DNA, 21 bp, Artificial Sequence
  Description of Artificial Sequence: Synthetic oligonucleotide
cgtgactcttaagagtcacgg

SEQ ID NO: 12126 - DNA, 21 bp, Artificial Sequence
  Description of Artificial Sequence: Synthetic oligonucleotide
ggcgactcttaagagtcgccg

SEQ ID NO: 12127 - DNA, 21 bp, Artificial Sequence
  Description of Artificial Sequence: Synthetic oligonucleotide
agcgactcttaagagtcgctg

SEQ ID NO: 12128 - DNA, 21 bp, Artificial Sequence
  Description of Artificial Sequence: Synthetic oligonucleotide
gacgactcttaagagtcgtcg

SEQ ID NO: 12129 - DNA, 21 bp, Artificial Sequence
  Description of Artificial Sequence: Synthetic oligonucleotide
ggagactcttaagagtctccg

SEQ ID NO: 12130 - DNA, 21 bp, Artificial Sequence
  Description of Artificial Sequence: Synthetic oligonucleotide
tgcgactcttaagagtcgcag

SEQ ID NO: 12131 - DNA, 21 bp, Artificial Sequence
  Description of Artificial Sequence: Synthetic oligonucleotide
ggtgactcttaagagtcaccg

SEQ ID NO: 12132 - DNA, 21 bp, Artificial Sequence
  Description of Artificial Sequence: Synthetic oligonucleotide
acggactcttaagagtccgtg

SEQ ID NO: 12133 - DNA, 21 bp, Artificial Sequence
  Description of Artificial Sequence: Synthetic oligonucleotide
ccagactcttaagagtctggg

SEQ ID NO: 12134 - DNA, 21 bp, Artificial Sequence
  Description of Artificial Sequence: Synthetic oligonucleotide
tcggactcttaagagtccgag

SEQ ID NO: 12135 - DNA, 21 bp, Artificial Sequence
  Description of Artificial Sequence: Synthetic oligonucleotide
cctgactcttaagagtcaggg

SEQ ID NO: 12136 - DNA, 21 bp, Artificial Sequence
  Description of Artificial Sequence: Synthetic oligonucleotide
cacgactcttaagagtcgtgg

SEQ ID NO: 12137 - DNA, 21 bp, Artificial Sequence
  Description of Artificial Sequence: Synthetic oligonucleotide
gccgactcttaagagtcggct

SEQ ID NO: 12138 - DNA, 21 bp, Artificial Sequence
  Description of Artificial Sequence: Synthetic oligonucleotide
gccgactcttaagagtcggca

SEQ ID NO: 12139 - DNA, 21 bp, Artificial Sequence
  Description of Artificial Sequence: Synthetic oligonucleotide
cgagactcttaagagtctcgc

SEQ ID NO: 12140 - DNA, 21 bp, Artificial Sequence
  Description of Artificial Sequence: Synthetic oligonucleotide
cgtgactcttaagagtcacgc

SEQ ID NO: 12141 - DNA, 21 bp, Artificial Sequence
  Description of Artificial Sequence: Synthetic oligonucleotide
caggactcttaagagtcctgc

SEQ ID NO: 12142 - DNA, 21 bp, Artificial Sequence
  Description of Artificial Sequence: Synthetic oligonucleotide
ctggactcttaagagtccagc

SEQ ID NO: 12143 - DNA, 21 bp, Artificial Sequence
  Description of Artificial Sequence: Synthetic oligonucleotide
gaggactcttaagagtcctcg

SEQ ID NO: 12144 - DNA, 21 bp, Artificial Sequence
  Description of Artificial Sequence: Synthetic oligonucleotide
gtggactcttaagagtccacg

SEQ ID NO: 12145 - DNA, 21 bp, Artificial Sequence
  Description of Artificial Sequence: Synthetic oligonucleotide
accgactcttaagagtcggtg

SEQ ID NO: 12146 - DNA, 21 bp, Artificial Sequence
  Description of Artificial Sequence: Synthetic oligonucleotide
tccgactcttaagagtcggag

SEQ ID NO: 12147 - DNA, 21 bp, Artificial Sequence
  Description of Artificial Sequence: Synthetic oligonucleotide
cgggactcttaagagtcccgc

SEQ ID NO: 12148 - DNA, 21 bp, Artificial Sequence
  Description of Artificial Sequence: Synthetic oligonucleotide
agggactcttaagagtccctc

SEQ ID NO: 12149 - DNA, 21 bp, Artificial Sequence
  Description of Artificial Sequence: Synthetic oligonucleotide
tgggactcttaagagtcccac

SEQ ID NO: 12150 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactccgcggagtcnnnn

SEQ ID NO: 12151 - DNA, 20 bp, Artificial Sequence
  Description of Artificial Sequence: Synthetic oligonucleotide
cggactccgcggagtccgcc

SEQ ID NO: 12152 - DNA, 20 bp, Artificial Sequence
  Description of Artificial Sequence: Synthetic oligonucleotide
cggactccgcggagtccgct

SEQ ID NO: 12153 - DNA, 20 bp, Artificial Sequence
  Description of Artificial Sequence: Synthetic oligonucleotide
cggactccgcggagtccgtc

SEQ ID NO: 12154 - DNA, 20 bp, Artificial Sequence
  Description of Artificial Sequence: Synthetic oligonucleotide
aggactccgcggagtcctcc

SEQ ID NO: 12155 - DNA, 20 bp, Artificial Sequence
  Description of Artificial Sequence: Synthetic oligonucleotide
cagactccgcggagtctgcc

SEQ ID NO: 12156 - DNA, 20 bp, Artificial Sequence
  Description of Artificial Sequence: Synthetic oligonucleotide
cggactccgcggagtccgca

SEQ ID NO: 12157 - DNA, 20 bp, Artificial Sequence
  Description of Artificial Sequence: Synthetic oligonucleotide
cggactccgcggagtccgac

SEQ ID NO: 12158 - DNA, 20 bp, Artificial Sequence
  Description of Artificial Sequence: Synthetic oligonucleotide
tggactccgcggagtccacc

SEQ ID NO: 12159 - DNA, 20 bp, Artificial Sequence
  Description of Artificial Sequence: Synthetic oligonucleotide
ctgactccgcggagtcagcc

SEQ ID NO: 12160 - DNA, 20 bp, Artificial Sequence
  Description of Artificial Sequence: Synthetic oligonucleotide
ccgactccgcggagtcgggc

SEQ ID NO: 12161 - DNA, 20 bp, Artificial Sequence
  Description of Artificial Sequence: Synthetic oligonucleotide
ccgactccgcggagtcgggt

SEQ ID NO: 12162 - DNA, 20 bp, Artificial Sequence
  Description of Artificial Sequence: Synthetic oligonucleotide
ccgactccgcggagtcggtc

SEQ ID NO: 12163 - DNA, 20 bp, Artificial Sequence
  Description of Artificial Sequence: Synthetic oligonucleotide
acgactccgcggagtcgtgc

SEQ ID NO: 12164 - DNA, 20 bp, Artificial Sequence
  Description of Artificial Sequence: Synthetic oligonucleotide
cagactccgcggagtctggc

SEQ ID NO: 12165 - DNA, 20 bp, Artificial Sequence
  Description of Artificial Sequence: Synthetic oligonucleotide
ccgactccgcggagtcggga

SEQ ID NO: 12166 - DNA, 20 bp, Artificial Sequence
  Description of Artificial Sequence: Synthetic oligonucleotide
ccgactccgcggagtcggac

SEQ ID NO: 12167 - DNA, 20 bp, Artificial Sequence
  Description of Artificial Sequence: Synthetic oligonucleotide
ctgactccgcggagtcaggc

SEQ ID NO: 12168 - DNA, 20 bp, Artificial Sequence
  Description of Artificial Sequence: Synthetic oligonucleotide
gcgactccgcggagtcgccc

SEQ ID NO: 12169 - DNA, 20 bp, Artificial Sequence
  Description of Artificial Sequence: Synthetic oligonucleotide
gcgactccgcggagtcgcct

SEQ ID NO: 12170 - DNA, 20 bp, Artificial Sequence
  Description of Artificial Sequence: Synthetic oligonucleotide
gcgactccgcggagtcgctc

SEQ ID NO: 12171 - DNA, 20 bp, Artificial Sequence
  Description of Artificial Sequence: Synthetic oligonucleotide
acgactccgcggagtcgtcc

SEQ ID NO: 12172 - DNA, 20 bp, Artificial Sequence
  Description of Artificial Sequence: Synthetic oligonucleotide
gagactccgcggagtctccc

SEQ ID NO: 12173 - DNA, 20 bp, Artificial Sequence
  Description of Artificial Sequence: Synthetic oligonucleotide
gcgactccgcggagtcgcca

SEQ ID NO: 12174 - DNA, 20 bp, Artificial Sequence
  Description of Artificial Sequence: Synthetic oligonucleotide
gcgactccgcggagtcgcac

SEQ ID NO: 12175 - DNA, 20 bp, Artificial Sequence
  Description of Artificial Sequence: Synthetic oligonucleotide
gtgactccgcggagtcaccc

SEQ ID NO: 12176 - DNA, 20 bp, Artificial Sequence
  Description of Artificial Sequence: Synthetic oligonucleotide
gggactccgcggagtcccgt

SEQ ID NO: 12177 - DNA, 20 bp, Artificial Sequence
  Description of Artificial Sequence: Synthetic oligonucleotide
gggactccgcggagtccctg

SEQ ID NO: 12178 - DNA, 20 bp, Artificial Sequence
  Description of Artificial Sequence: Synthetic oligonucleotide
aggactccgcggagtcctgg

SEQ ID NO: 12179 - DNA, 20 bp, Artificial Sequence
  Description of Artificial Sequence: Synthetic oligonucleotide
gagactccgcggagtctcgg

SEQ ID NO: 12180 - DNA, 20 bp, Artificial Sequence
  Description of Artificial Sequence: Synthetic oligonucleotide
gggactccgcggagtcccga

SEQ ID NO: 12181 - DNA, 20 bp, Artificial Sequence
  Description of Artificial Sequence: Synthetic oligonucleotide
gggactccgcggagtcccag

SEQ ID NO: 12182 - DNA, 20 bp, Artificial Sequence
  Description of Artificial Sequence: Synthetic oligonucleotide
tggactccgcggagtccagg

SEQ ID NO: 12183 - DNA, 20 bp, Artificial Sequence
  Description of Artificial Sequence: Synthetic oligonucleotide
gtgactccgcggagtcacgg

SEQ ID NO: 12184 - DNA, 20 bp, Artificial Sequence
  Description of Artificial Sequence: Synthetic oligonucleotide
gcgactccgcggagtcgccg

SEQ ID NO: 12185 - DNA, 20 bp, Artificial Sequence
  Description of Artificial Sequence: Synthetic oligonucleotide
gcgactccgcggagtcgctg

SEQ ID NO: 12186 - DNA, 20 bp, Artificial Sequence
  Description of Artificial Sequence: Synthetic oligonucleotide
acgactccgcggagtcgtcg

SEQ ID NO: 12187 - DNA, 20 bp, Artificial Sequence
  Description of Artificial Sequence: Synthetic oligonucleotide
gagactccgcggagtctccg

SEQ ID NO: 12188 - DNA, 20 bp, Artificial Sequence
  Description of Artificial Sequence: Synthetic oligonucleotide
gcgactccgcggagtcgcag

SEQ ID NO: 12189 - DNA, 20 bp, Artificial Sequence
  Description of Artificial Sequence: Synthetic oligonucleotide
gtgactccgcggagtcaccg

SEQ ID NO: 12190 - DNA, 20 bp, Artificial Sequence
  Description of Artificial Sequence: Synthetic oligonucleotide
cggactccgcggagtccgtg

SEQ ID NO: 12191 - DNA, 20 bp, Artificial Sequence
  Description of Artificial Sequence: Synthetic oligonucleotide
cagactccgcggagtctggg

SEQ ID NO: 12192 - DNA, 20 bp, Artificial Sequence
  Description of Artificial Sequence: Synthetic oligonucleotide
cggactccgcggagtccgag

SEQ ID NO: 12193 - DNA, 20 bp, Artificial Sequence
  Description of Artificial Sequence: Synthetic oligonucleotide
ctgactccgcggagtcaggg

SEQ ID NO: 12194 - DNA, 20 bp, Artificial Sequence
  Description of Artificial Sequence: Synthetic oligonucleotide
acgactccgcggagtcgtgg

SEQ ID NO: 12195 - DNA, 20 bp, Artificial Sequence
  Description of Artificial Sequence: Synthetic oligonucleotide
ccgactccgcggagtcggct

SEQ ID NO: 12196 - DNA, 20 bp, Artificial Sequence
  Description of Artificial Sequence: Synthetic oligonucleotide
ccgactccgcggagtcggca

SEQ ID NO: 12197 - DNA, 20 bp, Artificial Sequence
  Description of Artificial Sequence: Synthetic oligonucleotide
gagactccgcggagtctcgc

SEQ ID NO: 12198 - DNA, 20 bp, Artificial Sequence
  Description of Artificial Sequence: Synthetic oligonucleotide
gtgactccgcggagtcacgc

SEQ ID NO: 12199 - DNA, 20 bp, Artificial Sequence
  Description of Artificial Sequence: Synthetic oligonucleotide
aggactccgcggagtcctgc

SEQ ID NO: 12200 - DNA, 20 bp, Artificial Sequence
  Description of Artificial Sequence: Synthetic oligonucleotide
tggactccgcggagtccagc

SEQ ID NO: 12201 - DNA, 20 bp, Artificial Sequence
  Description of Artificial Sequence: Synthetic oligonucleotide
aggactccgcggagtcctcg

SEQ ID NO: 12202 - DNA, 20 bp, Artificial Sequence
  Description of Artificial Sequence: Synthetic oligonucleotide
tggactccgcggagtccacg

SEQ ID NO: 12203 - DNA, 20 bp, Artificial Sequence
  Description of Artificial Sequence: Synthetic oligonucleotide
ccgactccgcggagtcggtg

SEQ ID NO: 12204 - DNA, 20 bp, Artificial Sequence
  Description of Artificial Sequence: Synthetic oligonucleotide
ccgactccgcggagtcggag

SEQ ID NO: 12205 - DNA, 20 bp, Artificial Sequence
  Description of Artificial Sequence: Synthetic oligonucleotide
gggactccgcggagtcccgc

SEQ ID NO: 12206 - DNA, 20 bp, Artificial Sequence
  Description of Artificial Sequence: Synthetic oligonucleotide
gggactccgcggagtccctc

SEQ ID NO: 12207 - DNA, 20 bp, Artificial Sequence
  Description of Artificial Sequence: Synthetic oligonucleotide
gggactccgcggagtcccac

SEQ ID NO: 12208 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactctgcagagtcnnnn

SEQ ID NO: 12209 - DNA, 20 bp, Artificial Sequence
  Description of Artificial Sequence: Synthetic oligonucleotide
cggactctgcagagtccgcc

SEQ ID NO: 12210 - DNA, 20 bp, Artificial Sequence
  Description of Artificial Sequence: Synthetic oligonucleotide
cggactctgcagagtccgct

SEQ ID NO: 12211 - DNA, 20 bp, Artificial Sequence
  Description of Artificial Sequence: Synthetic oligonucleotide
cggactctgcagagtccgtc

SEQ ID NO: 12212 - DNA, 20 bp, Artificial Sequence
  Description of Artificial Sequence: Synthetic oligonucleotide
aggactctgcagagtcctcc

SEQ ID NO: 12213 - DNA, 20 bp, Artificial Sequence
  Description of Artificial Sequence: Synthetic oligonucleotide
cagactctgcagagtctgcc

SEQ ID NO: 12214 - DNA, 20 bp, Artificial Sequence
  Description of Artificial Sequence: Synthetic oligonucleotide
cggactctgcagagtccgca

SEQ ID NO: 12215 - DNA, 20 bp, Artificial Sequence
  Description of Artificial Sequence: Synthetic oligonucleotide
cggactctgcagagtccgac

SEQ ID NO: 12216 - DNA, 20 bp, Artificial Sequence
  Description of Artificial Sequence: Synthetic oligonucleotide
tggactctgcagagtccacc

SEQ ID NO: 12217 - DNA, 20 bp, Artificial Sequence
  Description of Artificial Sequence: Synthetic oligonucleotide
ctgactctgcagagtcagcc

SEQ ID NO: 12218 - DNA, 20 bp, Artificial Sequence
  Description of Artificial Sequence: Synthetic oligonucleotide
ccgactctgcagagtcgggc

SEQ ID NO: 12219 - DNA, 20 bp, Artificial Sequence
  Description of Artificial Sequence: Synthetic oligonucleotide
ccgactctgcagagtcgggt

SEQ ID NO: 12220 - DNA, 20 bp, Artificial Sequence
  Description of Artificial Sequence: Synthetic oligonucleotide
ccgactctgcagagtcggtc

SEQ ID NO: 12221 - DNA, 20 bp, Artificial Sequence
  Description of Artificial Sequence: Synthetic oligonucleotide
acgactctgcagagtcgtgc

SEQ ID NO: 12222 - DNA, 20 bp, Artificial Sequence
  Description of Artificial Sequence: Synthetic oligonucleotide
cagactctgcagagtctggc

SEQ ID NO: 12223 - DNA, 20 bp, Artificial Sequence
  Description of Artificial Sequence: Synthetic oligonucleotide
ccgactctgcagagtcggga

SEQ ID NO: 12224 - DNA, 20 bp, Artificial Sequence
  Description of Artificial Sequence: Synthetic oligonucleotide
ccgactctgcagagtcggac

SEQ ID NO: 12225 - DNA, 20 bp, Artificial Sequence
  Description of Artificial Sequence: Synthetic oligonucleotide
ctgactctgcagagtcaggc

SEQ ID NO: 12226 - DNA, 20 bp, Artificial Sequence
  Description of Artificial Sequence: Synthetic oligonucleotide
gcgactctgcagagtcgccc

SEQ ID NO: 12227 - DNA, 20 bp, Artificial Sequence
  Description of Artificial Sequence: Synthetic oligonucleotide
gcgactctgcagagtcgcct

SEQ ID NO: 12228 - DNA, 20 bp, Artificial Sequence
  Description of Artificial Sequence: Synthetic oligonucleotide
gcgactctgcagagtcgctc

SEQ ID NO: 12229 - DNA, 20 bp, Artificial Sequence
  Description of Artificial Sequence: Synthetic oligonucleotide
acgactctgcagagtcgtcc

SEQ ID NO: 12230 - DNA, 20 bp, Artificial Sequence
  Description of Artificial Sequence: Synthetic oligonucleotide
gagactctgcagagtctccc

SEQ ID NO: 12231 - DNA, 20 bp, Artificial Sequence
  Description of Artificial Sequence: Synthetic oligonucleotide
gcgactctgcagagtcgcca

SEQ ID NO: 12232 - DNA, 20 bp, Artificial Sequence
  Description of Artificial Sequence: Synthetic oligonucleotide
gcgactctgcagagtcgcac

SEQ ID NO: 12233 - DNA, 20 bp, Artificial Sequence
  Description of Artificial Sequence: Synthetic oligonucleotide
gtgactctgcagagtcaccc

SEQ ID NO: 12234 - DNA, 20 bp, Artificial Sequence
  Description of Artificial Sequence: Synthetic oligonucleotide
gggactctgcagagtcccgt

SEQ ID NO: 12235 - DNA, 20 bp, Artificial Sequence
  Description of Artificial Sequence: Synthetic oligonucleotide
gggactctgcagagtccctg

SEQ ID NO: 12236 - DNA, 20 bp, Artificial Sequence
  Description of Artificial Sequence: Synthetic oligonucleotide
aggactctgcagagtcctgg

SEQ ID NO: 12237 - DNA, 20 bp, Artificial Sequence
  Description of Artificial Sequence: Synthetic oligonucleotide
gagactctgcagagtctcgg

SEQ ID NO: 12238 - DNA, 20 bp, Artificial Sequence
  Description of Artificial Sequence: Synthetic oligonucleotide
gggactctgcagagtcccga

SEQ ID NO: 12239 - DNA, 20 bp, Artificial Sequence
  Description of Artificial Sequence: Synthetic oligonucleotide
gggactctgcagagtcccag

SEQ ID NO: 12240 - DNA, 20 bp, Artificial Sequence
  Description of Artificial Sequence: Synthetic oligonucleotide
tggactctgcagagtccagg

SEQ ID NO: 12241 - DNA, 20 bp, Artificial Sequence
  Description of Artificial Sequence: Synthetic oligonucleotide
gtgactctgcagagtcacgg

SEQ ID NO: 12242 - DNA, 20 bp, Artificial Sequence
  Description of Artificial Sequence: Synthetic oligonucleotide
gcgactctgcagagtcgccg

SEQ ID NO: 12243 - DNA, 20 bp, Artificial Sequence
  Description of Artificial Sequence: Synthetic oligonucleotide
gcgactctgcagagtcgctg

SEQ ID NO: 12244 - DNA, 20 bp, Artificial Sequence
  Description of Artificial Sequence: Synthetic oligonucleotide
acgactctgcagagtcgtcg

SEQ ID NO: 12245 - DNA, 20 bp, Artificial Sequence
  Description of Artificial Sequence: Synthetic oligonucleotide
gagactctgcagagtctccg

SEQ ID NO: 12246 - DNA, 20 bp, Artificial Sequence
  Description of Artificial Sequence: Synthetic oligonucleotide
gcgactctgcagagtcgcag

SEQ ID NO: 12247 - DNA, 20 bp, Artificial Sequence
  Description of Artificial Sequence: Synthetic oligonucleotide
gtgactctgcagagtcaccg

SEQ ID NO: 12248 - DNA, 20 bp, Artificial Sequence
  Description of Artificial Sequence: Synthetic oligonucleotide
cggactctgcagagtccgtg

SEQ ID NO: 12249 - DNA, 20 bp, Artificial Sequence
  Description of Artificial Sequence: Synthetic oligonucleotide
cagactctgcagagtctggg

SEQ ID NO: 12250 - DNA, 20 bp, Artificial Sequence
  Description of Artificial Sequence: Synthetic oligonucleotide
cggactctgcagagtccgag

SEQ ID NO: 12251 - DNA, 20 bp, Artificial Sequence
  Description of Artificial Sequence: Synthetic oligonucleotide
ctgactctgcagagtcaggg

SEQ ID NO: 12252 - DNA, 20 bp, Artificial Sequence
  Description of Artificial Sequence: Synthetic oligonucleotide
acgactctgcagagtcgtgg

SEQ ID NO: 12253 - DNA, 20 bp, Artificial Sequence
  Description of Artificial Sequence: Synthetic oligonucleotide
ccgactctgcagagtcggct

SEQ ID NO: 12254 - DNA, 20 bp, Artificial Sequence
  Description of Artificial Sequence: Synthetic oligonucleotide
ccgactctgcagagtcggca

SEQ ID NO: 12255 - DNA, 20 bp, Artificial Sequence
  Description of Artificial Sequence: Synthetic oligonucleotide
gagactctgcagagtctcgc

SEQ ID NO: 12256 - DNA, 20 bp, Artificial Sequence
  Description of Artificial Sequence: Synthetic oligonucleotide
gtgactctgcagagtcacgc

SEQ ID NO: 12257 - DNA, 20 bp, Artificial Sequence
  Description of Artificial Sequence: Synthetic oligonucleotide
aggactctgcagagtcctgc

SEQ ID NO: 12258 - DNA, 20 bp, Artificial Sequence
  Description of Artificial Sequence: Synthetic oligonucleotide
tggactctgcagagtccagc

SEQ ID NO: 12259 - DNA, 20 bp, Artificial Sequence
  Description of Artificial Sequence: Synthetic oligonucleotide
aggactctgcagagtcctcg

SEQ ID NO: 12260 - DNA, 20 bp, Artificial Sequence
  Description of Artificial Sequence: Synthetic oligonucleotide
tggactctgcagagtccacg

SEQ ID NO: 12261 - DNA, 20 bp, Artificial Sequence
  Description of Artificial Sequence: Synthetic oligonucleotide
ccgactctgcagagtcggtg

SEQ ID NO: 12262 - DNA, 20 bp, Artificial Sequence
  Description of Artificial Sequence: Synthetic oligonucleotide
ccgactctgcagagtcggag

SEQ ID NO: 12263 - DNA, 20 bp, Artificial Sequence
  Description of Artificial Sequence: Synthetic oligonucleotide
gggactctgcagagtcccgc

SEQ ID NO: 12264 - DNA, 20 bp, Artificial Sequence
  Description of Artificial Sequence: Synthetic oligonucleotide
gggactctgcagagtccctc

SEQ ID NO: 12265 - DNA, 20 bp, Artificial Sequence
  Description of Artificial Sequence: Synthetic oligonucleotide
gggactctgcagagtcccac

SEQ ID NO: 12266 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcgcgcgagtcnnnn

SEQ ID NO: 12267 - DNA, 20 bp, Artificial Sequence
  Description of Artificial Sequence: Synthetic oligonucleotide
cggactcgcgcgagtccgcc

SEQ ID NO: 12268 - DNA, 20 bp, Artificial Sequence
  Description of Artificial Sequence: Synthetic oligonucleotide
cggactcgcgcgagtccgct

SEQ ID NO: 12269 - DNA, 20 bp, Artificial Sequence
  Description of Artificial Sequence: Synthetic oligonucleotide
cggactcgcgcgagtccgtc

SEQ ID NO: 12270 - DNA, 20 bp, Artificial Sequence
  Description of Artificial Sequence: Synthetic oligonucleotide
aggactcgcgcgagtcctcc

SEQ ID NO: 12271 - DNA, 20 bp, Artificial Sequence
  Description of Artificial Sequence: Synthetic oligonucleotide
cagactcgcgcgagtctgcc

SEQ ID NO: 12272 - DNA, 20 bp, Artificial Sequence
  Description of Artificial Sequence: Synthetic oligonucleotide
cggactcgcgcgagtccgca

SEQ ID NO: 12273 - DNA, 20 bp, Artificial Sequence
  Description of Artificial Sequence: Synthetic oligonucleotide
cggactcgcgcgagtccgac

SEQ ID NO: 12274 - DNA, 20 bp, Artificial Sequence
  Description of Artificial Sequence: Synthetic oligonucleotide
tggactcgcgcgagtccacc

SEQ ID NO: 12275 - DNA, 20 bp, Artificial Sequence
  Description of Artificial Sequence: Synthetic oligonucleotide
ctgactcgcgcgagtcagcc

SEQ ID NO: 12276 - DNA, 20 bp, Artificial Sequence
  Description of Artificial Sequence: Synthetic oligonucleotide
ccgactcgcgcgagtcgggc

SEQ ID NO: 12277 - DNA, 20 bp, Artificial Sequence
  Description of Artificial Sequence: Synthetic oligonucleotide
ccgactcgcgcgagtcgggt

SEQ ID NO: 12278 - DNA, 20 bp, Artificial Sequence
  Description of Artificial Sequence: Synthetic oligonucleotide
ccgactcgcgcgagtcggtc

SEQ ID NO: 12279 - DNA, 20 bp, Artificial Sequence
  Description of Artificial Sequence: Synthetic oligonucleotide
acgactcgcgcgagtcgtgc

SEQ ID NO: 12280 - DNA, 20 bp, Artificial Sequence
  Description of Artificial Sequence: Synthetic oligonucleotide
cagactcgcgcgagtctggc

SEQ ID NO: 12281 - DNA, 20 bp, Artificial Sequence
  Description of Artificial Sequence: Synthetic oligonucleotide
ccgactcgcgcgagtcggga

SEQ ID NO: 12282 - DNA, 20 bp, Artificial Sequence
  Description of Artificial Sequence: Synthetic oligonucleotide
ccgactcgcgcgagtcggac

SEQ ID NO: 12283 - DNA, 20 bp, Artificial Sequence
  Description of Artificial Sequence: Synthetic oligonucleotide
ctgactcgcgcgagtcaggc

SEQ ID NO: 12284 - DNA, 20 bp, Artificial Sequence
  Description of Artificial Sequence: Synthetic oligonucleotide
gcgactcgcgcgagtcgccc

SEQ ID NO: 12285 - DNA, 20 bp, Artificial Sequence
  Description of Artificial Sequence: Synthetic oligonucleotide
gcgactcgcgcgagtcgcct

SEQ ID NO: 12286 - DNA, 20 bp, Artificial Sequence
  Description of Artificial Sequence: Synthetic oligonucleotide
gcgactcgcgcgagtcgctc

SEQ ID NO: 12287 - DNA, 20 bp, Artificial Sequence
  Description of Artificial Sequence: Synthetic oligonucleotide
acgactcgcgcgagtcgtcc

SEQ ID NO: 12288 - DNA, 20 bp, Artificial Sequence
  Description of Artificial Sequence: Synthetic oligonucleotide
gagactcgcgcgagtctccc

SEQ ID NO: 12289 - DNA, 20 bp, Artificial Sequence
  Description of Artificial Sequence: Synthetic oligonucleotide
gcgactcgcgcgagtcgcca

SEQ ID NO: 12290 - DNA, 20 bp, Artificial Sequence
  Description of Artificial Sequence: Synthetic oligonucleotide
gcgactcgcgcgagtcgcac

SEQ ID NO: 12291 - DNA, 20 bp, Artificial Sequence
  Description of Artificial Sequence: Synthetic oligonucleotide
gtgactcgcgcgagtcaccc

SEQ ID NO: 12292 - DNA, 20 bp, Artificial Sequence
  Description of Artificial Sequence: Synthetic oligonucleotide
gggactcgcgcgagtcccgt

SEQ ID NO: 12293 - DNA, 20 bp, Artificial Sequence
  Description of Artificial Sequence: Synthetic oligonucleotide
gggactcgcgcgagtccctg

SEQ ID NO: 12294 - DNA, 20 bp, Artificial Sequence
  Description of Artificial Sequence: Synthetic oligonucleotide
aggactcgcgcgagtcctgg

SEQ ID NO: 12295 - DNA, 20 bp, Artificial Sequence
  Description of Artificial Sequence: Synthetic oligonucleotide
gagactcgcgcgagtctcgg

SEQ ID NO: 12296 - DNA, 20 bp, Artificial Sequence
  Description of Artificial Sequence: Synthetic oligonucleotide
gggactcgcgcgagtcccga

SEQ ID NO: 12297 - DNA, 20 bp, Artificial Sequence
  Description of Artificial Sequence: Synthetic oligonucleotide
gggactcgcgcgagtcccag

SEQ ID NO: 12298 - DNA, 20 bp, Artificial Sequence
  Description of Artificial Sequence: Synthetic oligonucleotide
tggactcgcgcgagtccagg

SEQ ID NO: 12299 - DNA, 20 bp, Artificial Sequence
  Description of Artificial Sequence: Synthetic oligonucleotide
gtgactcgcgcgagtcacgg

SEQ ID NO: 12300 - DNA, 20 bp, Artificial Sequence
  Description of Artificial Sequence: Synthetic oligonucleotide
gcgactcgcgcgagtcgccg

SEQ ID NO: 12301 - DNA, 20 bp, Artificial Sequence
  Description of Artificial Sequence: Synthetic oligonucleotide
gcgactcgcgcgagtcgctg

SEQ ID NO: 12302 - DNA, 20 bp, Artificial Sequence
  Description of Artificial Sequence: Synthetic oligonucleotide
acgactcgcgcgagtcgtcg

SEQ ID NO: 12303 - DNA, 20 bp, Artificial Sequence
  Description of Artificial Sequence: Synthetic oligonucleotide
gagactcgcgcgagtctccg

SEQ ID NO: 12304 - DNA, 20 bp, Artificial Sequence
  Description of Artificial Sequence: Synthetic oligonucleotide
gcgactcgcgcgagtcgcag

SEQ ID NO: 12305 - DNA, 20 bp, Artificial Sequence
  Description of Artificial Sequence: Synthetic oligonucleotide
gtgactcgcgcgagtcaccg

SEQ ID NO: 12306 - DNA, 20 bp, Artificial Sequence
  Description of Artificial Sequence: Synthetic oligonucleotide
cggactcgcgcgagtccgtg

SEQ ID NO: 12307 - DNA, 20 bp, Artificial Sequence
  Description of Artificial Sequence: Synthetic oligonucleotide
cagactcgcgcgagtctggg

SEQ ID NO: 12308 - DNA, 20 bp, Artificial Sequence
  Description of Artificial Sequence: Synthetic oligonucleotide
cggactcgcgcgagtccgag

SEQ ID NO: 12309 - DNA, 20 bp, Artificial Sequence
  Description of Artificial Sequence: Synthetic oligonucleotide
ctgactcgcgcgagtcaggg

SEQ ID NO: 12310 - DNA, 20 bp, Artificial Sequence
  Description of Artificial Sequence: Synthetic oligonucleotide
acgactcgcgcgagtcgtgg

SEQ ID NO: 12311 - DNA, 20 bp, Artificial Sequence
  Description of Artificial Sequence: Synthetic oligonucleotide
ccgactcgcgcgagtcggct

SEQ ID NO: 12312 - DNA, 20 bp, Artificial Sequence
  Description of Artificial Sequence: Synthetic oligonucleotide
ccgactcgcgcgagtcggca

SEQ ID NO: 12313 - DNA, 20 bp, Artificial Sequence
  Description of Artificial Sequence: Synthetic oligonucleotide
gagactcgcgcgagtctcgc

SEQ ID NO: 12314 - DNA, 20 bp, Artificial Sequence
  Description of Artificial Sequence: Synthetic oligonucleotide
gtgactcgcgcgagtcacgc

SEQ ID NO: 12315 - DNA, 20 bp, Artificial Sequence
  Description of Artificial Sequence: Synthetic oligonucleotide
aggactcgcgcgagtcctgc

SEQ ID NO: 12316 - DNA, 20 bp, Artificial Sequence
  Description of Artificial Sequence: Synthetic oligonucleotide
tggactcgcgcgagtccagc

SEQ ID NO: 12317 - DNA, 20 bp, Artificial Sequence
  Description of Artificial Sequence: Synthetic oligonucleotide
aggactcgcgcgagtcctcg

SEQ ID NO: 12318 - DNA, 20 bp, Artificial Sequence
  Description of Artificial Sequence: Synthetic oligonucleotide
tggactcgcgcgagtccacg

SEQ ID NO: 12319 - DNA, 20 bp, Artificial Sequence
  Description of Artificial Sequence: Synthetic oligonucleotide
ccgactcgcgcgagtcggtg

SEQ ID NO: 12320 - DNA, 20 bp, Artificial Sequence
  Description of Artificial Sequence: Synthetic oligonucleotide
ccgactcgcgcgagtcggag

SEQ ID NO: 12321 - DNA, 20 bp, Artificial Sequence
  Description of Artificial Sequence: Synthetic oligonucleotide
gggactcgcgcgagtcccgc

SEQ ID NO: 12322 - DNA, 20 bp, Artificial Sequence
  Description of Artificial Sequence: Synthetic oligonucleotide
gggactcgcgcgagtccctc

SEQ ID NO: 12323 - DNA, 20 bp, Artificial Sequence
  Description of Artificial Sequence: Synthetic oligonucleotide
gggactcgcgcgagtcccac

SEQ ID NO: 12324 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcacgtgagtcnnnn

SEQ ID NO: 12325 - DNA, 20 bp, Artificial Sequence
  Description of Artificial Sequence: Synthetic oligonucleotide
cggactcacgtgagtccgcc

SEQ ID NO: 12326 - DNA, 20 bp, Artificial Sequence
  Description of Artificial Sequence: Synthetic oligonucleotide
cggactcacgtgagtccgct

SEQ ID NO: 12327 - DNA, 20 bp, Artificial Sequence
  Description of Artificial Sequence: Synthetic oligonucleotide
cggactcacgtgagtccgtc

SEQ ID NO: 12328 - DNA, 20 bp, Artificial Sequence
  Description of Artificial Sequence: Synthetic oligonucleotide
aggactcacgtgagtcctcc

SEQ ID NO: 12329 - DNA, 20 bp, Artificial Sequence
  Description of Artificial Sequence: Synthetic oligonucleotide
cagactcacgtgagtctgcc

SEQ ID NO: 12330 - DNA, 20 bp, Artificial Sequence
  Description of Artificial Sequence: Synthetic oligonucleotide
cggactcacgtgagtccgca

SEQ ID NO: 12331 - DNA, 20 bp, Artificial Sequence
  Description of Artificial Sequence: Synthetic oligonucleotide
cggactcacgtgagtccgac

SEQ ID NO: 12332 - DNA, 20 bp, Artificial Sequence
  Description of Artificial Sequence: Synthetic oligonucleotide
tggactcacgtgagtccacc

SEQ ID NO: 12333 - DNA, 20 bp, Artificial Sequence
  Description of Artificial Sequence: Synthetic oligonucleotide
ctgactcacgtgagtcagcc

SEQ ID NO: 12334 - DNA, 20 bp, Artificial Sequence
  Description of Artificial Sequence: Synthetic oligonucleotide
ccgactcacgtgagtcgggc

SEQ ID NO: 12335 - DNA, 20 bp, Artificial Sequence
  Description of Artificial Sequence: Synthetic oligonucleotide
ccgactcacgtgagtcgggt

SEQ ID NO: 12336 - DNA, 20 bp, Artificial Sequence
  Description of Artificial Sequence: Synthetic oligonucleotide
ccgactcacgtgagtcggtc

SEQ ID NO: 12337 - DNA, 20 bp, Artificial Sequence
  Description of Artificial Sequence: Synthetic oligonucleotide
acgactcacgtgagtcgtgc

SEQ ID NO: 12338 - DNA, 20 bp, Artificial Sequence
  Description of Artificial Sequence: Synthetic oligonucleotide
cagactcacgtgagtctggc

SEQ ID NO: 12339 - DNA, 20 bp, Artificial Sequence
  Description of Artificial Sequence: Synthetic oligonucleotide
ccgactcacgtgagtcggga

SEQ ID NO: 12340 - DNA, 20 bp, Artificial Sequence
  Description of Artificial Sequence: Synthetic oligonucleotide
ccgactcacgtgagtcggac

SEQ ID NO: 12341 - DNA, 20 bp, Artificial Sequence
  Description of Artificial Sequence: Synthetic oligonucleotide
ctgactcacgtgagtcaggc

SEQ ID NO: 12342 - DNA, 20 bp, Artificial Sequence
  Description of Artificial Sequence: Synthetic oligonucleotide
gcgactcacgtgagtcgccc

SEQ ID NO: 12343 - DNA, 20 bp, Artificial Sequence
  Description of Artificial Sequence: Synthetic oligonucleotide
gcgactcacgtgagtcgcct

SEQ ID NO: 12344 - DNA, 20 bp, Artificial Sequence
  Description of Artificial Sequence: Synthetic oligonucleotide
gcgactcacgtgagtcgctc

SEQ ID NO: 12345 - DNA, 20 bp, Artificial Sequence
  Description of Artificial Sequence: Synthetic oligonucleotide
acgactcacgtgagtcgtcc

SEQ ID NO: 12346 - DNA, 20 bp, Artificial Sequence
  Description of Artificial Sequence: Synthetic oligonucleotide
gagactcacgtgagtctccc

SEQ ID NO: 12347 - DNA, 20 bp, Artificial Sequence
  Description of Artificial Sequence: Synthetic oligonucleotide
gcgactcacgtgagtcgcca

SEQ ID NO: 12348 - DNA, 20 bp, Artificial Sequence
  Description of Artificial Sequence: Synthetic oligonucleotide
gcgactcacgtgagtcgcac

SEQ ID NO: 12349 - DNA, 20 bp, Artificial Sequence
  Description of Artificial Sequence: Synthetic oligonucleotide
gtgactcacgtgagtcaccc

SEQ ID NO: 12350 - DNA, 20 bp, Artificial Sequence
  Description of Artificial Sequence: Synthetic oligonucleotide
gggactcacgtgagtcccgt

SEQ ID NO: 12351 - DNA, 20 bp, Artificial Sequence
  Description of Artificial Sequence: Synthetic oligonucleotide
gggactcacgtgagtccctg

SEQ ID NO: 12352 - DNA, 20 bp, Artificial Sequence
  Description of Artificial Sequence: Synthetic oligonucleotide
aggactcacgtgagtcctgg

SEQ ID NO: 12353 - DNA, 20 bp, Artificial Sequence
  Description of Artificial Sequence: Synthetic oligonucleotide
gagactcacgtgagtctcgg

SEQ ID NO: 12354 - DNA, 20 bp, Artificial Sequence
  Description of Artificial Sequence: Synthetic oligonucleotide
gggactcacgtgagtcccga

SEQ ID NO: 12355 - DNA, 20 bp, Artificial Sequence
  Description of Artificial Sequence: Synthetic oligonucleotide
gggactcacgtgagtcccag

SEQ ID NO: 12356 - DNA, 20 bp, Artificial Sequence
  Description of Artificial Sequence: Synthetic oligonucleotide
tggactcacgtgagtccagg

SEQ ID NO: 12357 - DNA, 20 bp, Artificial Sequence
  Description of Artificial Sequence: Synthetic oligonucleotide
gtgactcacgtgagtcacgg

SEQ ID NO: 12358 - DNA, 20 bp, Artificial Sequence
  Description of Artificial Sequence: Synthetic oligonucleotide
gcgactcacgtgagtcgccg

SEQ ID NO: 12359 - DNA, 20 bp, Artificial Sequence
  Description of Artificial Sequence: Synthetic oligonucleotide
gcgactcacgtgagtcgctg

SEQ ID NO: 12360 - DNA, 20 bp, Artificial Sequence
  Description of Artificial Sequence: Synthetic oligonucleotide
acgactcacgtgagtcgtcg

SEQ ID NO: 12361 - DNA, 20 bp, Artificial Sequence
  Description of Artificial Sequence: Synthetic oligonucleotide
gagactcacgtgagtctccg

SEQ ID NO: 12362 - DNA, 20 bp, Artificial Sequence
  Description of Artificial Sequence: Synthetic oligonucleotide
gcgactcacgtgagtcgcag

SEQ ID NO: 12363 - DNA, 20 bp, Artificial Sequence
  Description of Artificial Sequence: Synthetic oligonucleotide
gtgactcacgtgagtcaccg

SEQ ID NO: 12364 - DNA, 20 bp, Artificial Sequence
  Description of Artificial Sequence: Synthetic oligonucleotide
cggactcacgtgagtccgtg

SEQ ID NO: 12365 - DNA, 20 bp, Artificial Sequence
  Description of Artificial Sequence: Synthetic oligonucleotide
cagactcacgtgagtctggg

SEQ ID NO: 12366 - DNA, 20 bp, Artificial Sequence
  Description of Artificial Sequence: Synthetic oligonucleotide
cggactcacgtgagtccgag

SEQ ID NO: 12367 - DNA, 20 bp, Artificial Sequence
  Description of Artificial Sequence: Synthetic oligonucleotide
ctgactcacgtgagtcaggg

SEQ ID NO: 12368 - DNA, 20 bp, Artificial Sequence
  Description of Artificial Sequence: Synthetic oligonucleotide
acgactcacgtgagtcgtgg

SEQ ID NO: 12369 - DNA, 20 bp, Artificial Sequence
  Description of Artificial Sequence: Synthetic oligonucleotide
ccgactcacgtgagtcggct

SEQ ID NO: 12370 - DNA, 20 bp, Artificial Sequence
  Description of Artificial Sequence: Synthetic oligonucleotide
ccgactcacgtgagtcggca

SEQ ID NO: 12371 - DNA, 20 bp, Artificial Sequence
  Description of Artificial Sequence: Synthetic oligonucleotide
gagactcacgtgagtctcgc

SEQ ID NO: 12372 - DNA, 20 bp, Artificial Sequence
  Description of Artificial Sequence: Synthetic oligonucleotide
gtgactcacgtgagtcacgc

SEQ ID NO: 12373 - DNA, 20 bp, Artificial Sequence
  Description of Artificial Sequence: Synthetic oligonucleotide
aggactcacgtgagtcctgc

SEQ ID NO: 12374 - DNA, 20 bp, Artificial Sequence
  Description of Artificial Sequence: Synthetic oligonucleotide
tggactcacgtgagtccagc

SEQ ID NO: 12375 - DNA, 20 bp, Artificial Sequence
  Description of Artificial Sequence: Synthetic oligonucleotide
aggactcacgtgagtcctcg

SEQ ID NO: 12376 - DNA, 20 bp, Artificial Sequence
  Description of Artificial Sequence: Synthetic oligonucleotide
tggactcacgtgagtccacg

SEQ ID NO: 12377 - DNA, 20 bp, Artificial Sequence
  Description of Artificial Sequence: Synthetic oligonucleotide
ccgactcacgtgagtcggtg

SEQ ID NO: 12378 - DNA, 20 bp, Artificial Sequence
  Description of Artificial Sequence: Synthetic oligonucleotide
ccgactcacgtgagtcggag

SEQ ID NO: 12379 - DNA, 20 bp, Artificial Sequence
  Description of Artificial Sequence: Synthetic oligonucleotide
gggactcacgtgagtcccgc

SEQ ID NO: 12380 - DNA, 20 bp, Artificial Sequence
  Description of Artificial Sequence: Synthetic oligonucleotide
gggactcacgtgagtccctc

SEQ ID NO: 12381 - DNA, 20 bp, Artificial Sequence
  Description of Artificial Sequence: Synthetic oligonucleotide
gggactcacgtgagtcccac

SEQ ID NO: 12382 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcggccgagtcnnnn

SEQ ID NO: 12383 - DNA, 20 bp, Artificial Sequence
  Description of Artificial Sequence: Synthetic oligonucleotide
cggactcggccgagtccgcc

SEQ ID NO: 12384 - DNA, 20 bp, Artificial Sequence
  Description of Artificial Sequence: Synthetic oligonucleotide
cggactcggccgagtccgct

SEQ ID NO: 12385 - DNA, 20 bp, Artificial Sequence
  Description of Artificial Sequence: Synthetic oligonucleotide
cggactcggccgagtccgtc

SEQ ID NO: 12386 - DNA, 20 bp, Artificial Sequence
  Description of Artificial Sequence: Synthetic oligonucleotide
aggactcggccgagtcctcc

SEQ ID NO: 12387 - DNA, 20 bp, Artificial Sequence
  Description of Artificial Sequence: Synthetic oligonucleotide
cagactcggccgagtctgcc

SEQ ID NO: 12388 - DNA, 20 bp, Artificial Sequence
  Description of Artificial Sequence: Synthetic oligonucleotide
cggactcggccgagtccgca

SEQ ID NO: 12389 - DNA, 20 bp, Artificial Sequence
  Description of Artificial Sequence: Synthetic oligonucleotide
cggactcggccgagtccgac

SEQ ID NO: 12390 - DNA, 20 bp, Artificial Sequence
  Description of Artificial Sequence: Synthetic oligonucleotide
tggactcggccgagtccacc

SEQ ID NO: 12391 - DNA, 20 bp, Artificial Sequence
  Description of Artificial Sequence: Synthetic oligonucleotide
ctgactcggccgagtcagcc

SEQ ID NO: 12392 - DNA, 20 bp, Artificial Sequence
  Description of Artificial Sequence: Synthetic oligonucleotide
ccgactcggccgagtcgggc

SEQ ID NO: 12393 - DNA, 20 bp, Artificial Sequence
  Description of Artificial Sequence: Synthetic oligonucleotide
ccgactcggccgagtcgggt

SEQ ID NO: 12394 - DNA, 20 bp, Artificial Sequence
  Description of Artificial Sequence: Synthetic oligonucleotide
ccgactcggccgagtcggtc

SEQ ID NO: 12395 - DNA, 20 bp, Artificial Sequence
  Description of Artificial Sequence: Synthetic oligonucleotide
acgactcggccgagtcgtgc

SEQ ID NO: 12396 - DNA, 20 bp, Artificial Sequence
  Description of Artificial Sequence: Synthetic oligonucleotide
cagactcggccgagtctggc

SEQ ID NO: 12397 - DNA, 20 bp, Artificial Sequence
  Description of Artificial Sequence: Synthetic oligonucleotide
ccgactcggccgagtcggga

SEQ ID NO: 12398 - DNA, 20 bp, Artificial Sequence
  Description of Artificial Sequence: Synthetic oligonucleotide
ccgactcggccgagtcggac

SEQ ID NO: 12399 - DNA, 20 bp, Artificial Sequence
  Description of Artificial Sequence: Synthetic oligonucleotide
ctgactcggccgagtcaggc

SEQ ID NO: 12400 - DNA, 20 bp, Artificial Sequence
  Description of Artificial Sequence: Synthetic oligonucleotide
gcgactcggccgagtcgccc

SEQ ID NO: 12401 - DNA, 20 bp, Artificial Sequence
  Description of Artificial Sequence: Synthetic oligonucleotide
gcgactcggccgagtcgcct

SEQ ID NO: 12402 - DNA, 20 bp, Artificial Sequence
  Description of Artificial Sequence: Synthetic oligonucleotide
gcgactcggccgagtcgctc

SEQ ID NO: 12403 - DNA, 20 bp, Artificial Sequence
  Description of Artificial Sequence: Synthetic oligonucleotide
acgactcggccgagtcgtcc

SEQ ID NO: 12404 - DNA, 20 bp, Artificial Sequence
  Description of Artificial Sequence: Synthetic oligonucleotide
gagactcggccgagtctccc

SEQ ID NO: 12405 - DNA, 20 bp, Artificial Sequence
  Description of Artificial Sequence: Synthetic oligonucleotide
gcgactcggccgagtcgcca

SEQ ID NO: 12406 - DNA, 20 bp, Artificial Sequence
  Description of Artificial Sequence: Synthetic oligonucleotide
gcgactcggccgagtcgcac

SEQ ID NO: 12407 - DNA, 20 bp, Artificial Sequence
  Description of Artificial Sequence: Synthetic oligonucleotide
gtgactcggccgagtcaccc

SEQ ID NO: 12408 - DNA, 20 bp, Artificial Sequence
  Description of Artificial Sequence: Synthetic oligonucleotide
gggactcggccgagtcccgt

SEQ ID NO: 12409 - DNA, 20 bp, Artificial Sequence
  Description of Artificial Sequence: Synthetic oligonucleotide
gggactcggccgagtccctg

SEQ ID NO: 12410 - DNA, 20 bp, Artificial Sequence
  Description of Artificial Sequence: Synthetic oligonucleotide
aggactcggccgagtcctgg

SEQ ID NO: 12411 - DNA, 20 bp, Artificial Sequence
  Description of Artificial Sequence: Synthetic oligonucleotide
gagactcggccgagtctcgg

SEQ ID NO: 12412 - DNA, 20 bp, Artificial Sequence
  Description of Artificial Sequence: Synthetic oligonucleotide
gggactcggccgagtcccga

SEQ ID NO: 12413 - DNA, 20 bp, Artificial Sequence
  Description of Artificial Sequence: Synthetic oligonucleotide
gggactcggccgagtcccag

SEQ ID NO: 12414 - DNA, 20 bp, Artificial Sequence
  Description of Artificial Sequence: Synthetic oligonucleotide
tggactcggccgagtccagg

SEQ ID NO: 12415 - DNA, 20 bp, Artificial Sequence
  Description of Artificial Sequence: Synthetic oligonucleotide
gtgactcggccgagtcacgg

SEQ ID NO: 12416 - DNA, 20 bp, Artificial Sequence
  Description of Artificial Sequence: Synthetic oligonucleotide
gcgactcggccgagtcgccg

SEQ ID NO: 12417 - DNA, 20 bp, Artificial Sequence
  Description of Artificial Sequence: Synthetic oligonucleotide
gcgactcggccgagtcgctg

SEQ ID NO: 12418 - DNA, 20 bp, Artificial Sequence
  Description of Artificial Sequence: Synthetic oligonucleotide
acgactcggccgagtcgtcg

SEQ ID NO: 12419 - DNA, 20 bp, Artificial Sequence
  Description of Artificial Sequence: Synthetic oligonucleotide
gagactcggccgagtctccg

SEQ ID NO: 12420 - DNA, 20 bp, Artificial Sequence
  Description of Artificial Sequence: Synthetic oligonucleotide
gcgactcggccgagtcgcag

SEQ ID NO: 12421 - DNA, 20 bp, Artificial Sequence
  Description of Artificial Sequence: Synthetic oligonucleotide
gtgactcggccgagtcaccg

SEQ ID NO: 12422 - DNA, 20 bp, Artificial Sequence
  Description of Artificial Sequence: Synthetic oligonucleotide
cggactcggccgagtccgtg

SEQ ID NO: 12423 - DNA, 20 bp, Artificial Sequence
  Description of Artificial Sequence: Synthetic oligonucleotide
cagactcggccgagtctggg

SEQ ID NO: 12424 - DNA, 20 bp, Artificial Sequence
  Description of Artificial Sequence: Synthetic oligonucleotide
cggactcggccgagtccgag

SEQ ID NO: 12425 - DNA, 20 bp, Artificial Sequence
  Description of Artificial Sequence: Synthetic oligonucleotide
ctgactcggccgagtcaggg

SEQ ID NO: 12426 - DNA, 20 bp, Artificial Sequence
  Description of Artificial Sequence: Synthetic oligonucleotide
acgactcggccgagtcgtgg

SEQ ID NO: 12427 - DNA, 20 bp, Artificial Sequence
  Description of Artificial Sequence: Synthetic oligonucleotide
ccgactcggccgagtcggct

SEQ ID NO: 12428 - DNA, 20 bp, Artificial Sequence
  Description of Artificial Sequence: Synthetic oligonucleotide
ccgactcggccgagtcggca

SEQ ID NO: 12429 - DNA, 20 bp, Artificial Sequence
  Description of Artificial Sequence: Synthetic oligonucleotide
gagactcggccgagtctcgc

SEQ ID NO: 12430 - DNA, 20 bp, Artificial Sequence
  Description of Artificial Sequence: Synthetic oligonucleotide
gtgactcggccgagtcacgc

SEQ ID NO: 12431 - DNA, 20 bp, Artificial Sequence
  Description of Artificial Sequence: Synthetic oligonucleotide
aggactcggccgagtcctgc

SEQ ID NO: 12432 - DNA, 20 bp, Artificial Sequence
  Description of Artificial Sequence: Synthetic oligonucleotide
tggactcggccgagtccagc

SEQ ID NO: 12433 - DNA, 20 bp, Artificial Sequence
  Description of Artificial Sequence: Synthetic oligonucleotide
aggactcggccgagtcctcg

SEQ ID NO: 12434 - DNA, 20 bp, Artificial Sequence
  Description of Artificial Sequence: Synthetic oligonucleotide
tggactcggccgagtccacg

SEQ ID NO: 12435 - DNA, 20 bp, Artificial Sequence
  Description of Artificial Sequence: Synthetic oligonucleotide
ccgactcggccgagtcggtg

SEQ ID NO: 12436 - DNA, 20 bp, Artificial Sequence
  Description of Artificial Sequence: Synthetic oligonucleotide
ccgactcggccgagtcggag

SEQ ID NO: 12437 - DNA, 20 bp, Artificial Sequence
  Description of Artificial Sequence: Synthetic oligonucleotide
gggactcggccgagtcccgc

SEQ ID NO: 12438 - DNA, 20 bp, Artificial Sequence
  Description of Artificial Sequence: Synthetic oligonucleotide
gggactcggccgagtccctc

SEQ ID NO: 12439 - DNA, 20 bp, Artificial Sequence
  Description of Artificial Sequence: Synthetic oligonucleotide
gggactcggccgagtcccac

SEQ ID NO: 12440 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcccgggagtcnnnn

SEQ ID NO: 12441 - DNA, 20 bp, Artificial Sequence
  Description of Artificial Sequence: Synthetic oligonucleotide
cggactcccgggagtccgcc

SEQ ID NO: 12442 - DNA, 20 bp, Artificial Sequence
  Description of Artificial Sequence: Synthetic oligonucleotide
cggactcccgggagtccgct

SEQ ID NO: 12443 - DNA, 20 bp, Artificial Sequence
  Description of Artificial Sequence: Synthetic oligonucleotide
cggactcccgggagtccgtc

SEQ ID NO: 12444 - DNA, 20 bp, Artificial Sequence
  Description of Artificial Sequence: Synthetic oligonucleotide
aggactcccgggagtcctcc

SEQ ID NO: 12445 - DNA, 20 bp, Artificial Sequence
  Description of Artificial Sequence: Synthetic oligonucleotide
cagactcccgggagtctgcc

SEQ ID NO: 12446 - DNA, 20 bp, Artificial Sequence
  Description of Artificial Sequence: Synthetic oligonucleotide
cggactcccgggagtccgca

SEQ ID NO: 12447 - DNA, 20 bp, Artificial Sequence
  Description of Artificial Sequence: Synthetic oligonucleotide
cggactcccgggagtccgac

SEQ ID NO: 12448 - DNA, 20 bp, Artificial Sequence
  Description of Artificial Sequence: Synthetic oligonucleotide
tggactcccgggagtccacc

SEQ ID NO: 12449 - DNA, 20 bp, Artificial Sequence
  Description of Artificial Sequence: Synthetic oligonucleotide
ctgactcccgggagtcagcc

SEQ ID NO: 12450 - DNA, 20 bp, Artificial Sequence
  Description of Artificial Sequence: Synthetic oligonucleotide
ccgactcccgggagtcgggc

SEQ ID NO: 12451 - DNA, 20 bp, Artificial Sequence
  Description of Artificial Sequence: Synthetic oligonucleotide
ccgactcccgggagtcgggt

SEQ ID NO: 12452 - DNA, 20 bp, Artificial Sequence
  Description of Artificial Sequence: Synthetic oligonucleotide
ccgactcccgggagtcggtc

SEQ ID NO: 12453 - DNA, 20 bp, Artificial Sequence
  Description of Artificial Sequence: Synthetic oligonucleotide
acgactcccgggagtcgtgc

SEQ ID NO: 12454 - DNA, 20 bp, Artificial Sequence
  Description of Artificial Sequence: Synthetic oligonucleotide
cagactcccgggagtctggc

SEQ ID NO: 12455 - DNA, 20 bp, Artificial Sequence
  Description of Artificial Sequence: Synthetic oligonucleotide
ccgactcccgggagtcggga

SEQ ID NO: 12456 - DNA, 20 bp, Artificial Sequence
  Description of Artificial Sequence: Synthetic oligonucleotide
ccgactcccgggagtcggac

SEQ ID NO: 12457 - DNA, 20 bp, Artificial Sequence
  Description of Artificial Sequence: Synthetic oligonucleotide
ctgactcccgggagtcaggc

SEQ ID NO: 12458 - DNA, 20 bp, Artificial Sequence
  Description of Artificial Sequence: Synthetic oligonucleotide
gcgactcccgggagtcgccc

SEQ ID NO: 12459 - DNA, 20 bp, Artificial Sequence
  Description of Artificial Sequence: Synthetic oligonucleotide
gcgactcccgggagtcgcct

SEQ ID NO: 12460 - DNA, 20 bp, Artificial Sequence
  Description of Artificial Sequence: Synthetic oligonucleotide
gcgactcccgggagtcgctc

SEQ ID NO: 12461 - DNA, 20 bp, Artificial Sequence
  Description of Artificial Sequence: Synthetic oligonucleotide
acgactcccgggagtcgtcc

SEQ ID NO: 12462 - DNA, 20 bp, Artificial Sequence
  Description of Artificial Sequence: Synthetic oligonucleotide
gagactcccgggagtctccc

SEQ ID NO: 12463 - DNA, 20 bp, Artificial Sequence
  Description of Artificial Sequence: Synthetic oligonucleotide
gcgactcccgggagtcgcca

SEQ ID NO: 12464 - DNA, 20 bp, Artificial Sequence
  Description of Artificial Sequence: Synthetic oligonucleotide
gcgactcccgggagtcgcac

SEQ ID NO: 12465 - DNA, 20 bp, Artificial Sequence
  Description of Artificial Sequence: Synthetic oligonucleotide
gtgactcccgggagtcaccc

SEQ ID NO: 12466 - DNA, 20 bp, Artificial Sequence
  Description of Artificial Sequence: Synthetic oligonucleotide
gggactcccgggagtcccgt

SEQ ID NO: 12467 - DNA, 20 bp, Artificial Sequence
  Description of Artificial Sequence: Synthetic oligonucleotide
gggactcccgggagtccctg

SEQ ID NO: 12468 - DNA, 20 bp, Artificial Sequence
  Description of Artificial Sequence: Synthetic oligonucleotide
aggactcccgggagtcctgg

SEQ ID NO: 12469 - DNA, 20 bp, Artificial Sequence
  Description of Artificial Sequence: Synthetic oligonucleotide
gagactcccgggagtctcgg

SEQ ID NO: 12470 - DNA, 20 bp, Artificial Sequence
  Description of Artificial Sequence: Synthetic oligonucleotide
gggactcccgggagtcccga

SEQ ID NO: 12471 - DNA, 20 bp, Artificial Sequence
  Description of Artificial Sequence: Synthetic oligonucleotide
gggactcccgggagtcccag

SEQ ID NO: 12472 - DNA, 20 bp, Artificial Sequence
  Description of Artificial Sequence: Synthetic oligonucleotide
tggactcccgggagtccagg

SEQ ID NO: 12473 - DNA, 20 bp, Artificial Sequence
  Description of Artificial Sequence: Synthetic oligonucleotide
gtgactcccgggagtcacgg

SEQ ID NO: 12474 - DNA, 20 bp, Artificial Sequence
  Description of Artificial Sequence: Synthetic oligonucleotide
gcgactcccgggagtcgccg

SEQ ID NO: 12475 - DNA, 20 bp, Artificial Sequence
  Description of Artificial Sequence: Synthetic oligonucleotide
gcgactcccgggagtcgctg

SEQ ID NO: 12476 - DNA, 20 bp, Artificial Sequence
  Description of Artificial Sequence: Synthetic oligonucleotide
acgactcccgggagtcgtcg

SEQ ID NO: 12477 - DNA, 20 bp, Artificial Sequence
  Description of Artificial Sequence: Synthetic oligonucleotide
gagactcccgggagtctccg

SEQ ID NO: 12478 - DNA, 20 bp, Artificial Sequence
  Description of Artificial Sequence: Synthetic oligonucleotide
gcgactcccgggagtcgcag

SEQ ID NO: 12479 - DNA, 20 bp, Artificial Sequence
  Description of Artificial Sequence: Synthetic oligonucleotide
gtgactcccgggagtcaccg

SEQ ID NO: 12480 - DNA, 20 bp, Artificial Sequence
  Description of Artificial Sequence: Synthetic oligonucleotide
cggactcccgggagtccgtg

SEQ ID NO: 12481 - DNA, 20 bp, Artificial Sequence
  Description of Artificial Sequence: Synthetic oligonucleotide
cagactcccgggagtctggg

SEQ ID NO: 12482 - DNA, 20 bp, Artificial Sequence
  Description of Artificial Sequence: Synthetic oligonucleotide
cggactcccgggagtccgag

SEQ ID NO: 12483 - DNA, 20 bp, Artificial Sequence
  Description of Artificial Sequence: Synthetic oligonucleotide
ctgactcccgggagtcaggg

SEQ ID NO: 12484 - DNA, 20 bp, Artificial Sequence
  Description of Artificial Sequence: Synthetic oligonucleotide
acgactcccgggagtcgtgg

SEQ ID NO: 12485 - DNA, 20 bp, Artificial Sequence
  Description of Artificial Sequence: Synthetic oligonucleotide
ccgactcccgggagtcggct

SEQ ID NO: 12486 - DNA, 20 bp, Artificial Sequence
  Description of Artificial Sequence: Synthetic oligonucleotide
ccgactcccgggagtcggca

SEQ ID NO: 12487 - DNA, 20 bp, Artificial Sequence
  Description of Artificial Sequence: Synthetic oligonucleotide
gagactcccgggagtctcgc

SEQ ID NO: 12488 - DNA, 20 bp, Artificial Sequence
  Description of Artificial Sequence: Synthetic oligonucleotide
gtgactcccgggagtcacgc

SEQ ID NO: 12489 - DNA, 20 bp, Artificial Sequence
  Description of Artificial Sequence: Synthetic oligonucleotide
aggactcccgggagtcctgc

SEQ ID NO: 12490 - DNA, 20 bp, Artificial Sequence
  Description of Artificial Sequence: Synthetic oligonucleotide
tggactcccgggagtccagc

SEQ ID NO: 12491 - DNA, 20 bp, Artificial Sequence
  Description of Artificial Sequence: Synthetic oligonucleotide
aggactcccgggagtcctcg

SEQ ID NO: 12492 - DNA, 20 bp, Artificial Sequence
  Description of Artificial Sequence: Synthetic oligonucleotide
tggactcccgggagtccacg

SEQ ID NO: 12493 - DNA, 20 bp, Artificial Sequence
  Description of Artificial Sequence: Synthetic oligonucleotide
ccgactcccgggagtcggtg

SEQ ID NO: 12494 - DNA, 20 bp, Artificial Sequence
  Description of Artificial Sequence: Synthetic oligonucleotide
ccgactcccgggagtcggag

SEQ ID NO: 12495 - DNA, 20 bp, Artificial Sequence
  Description of Artificial Sequence: Synthetic oligonucleotide
gggactcccgggagtcccgc

SEQ ID NO: 12496 - DNA, 20 bp, Artificial Sequence
  Description of Artificial Sequence: Synthetic oligonucleotide
gggactcccgggagtccctc

SEQ ID NO: 12497 - DNA, 20 bp, Artificial Sequence
  Description of Artificial Sequence: Synthetic oligonucleotide
gggactcccgggagtcccac

SEQ ID NO: 12498 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcgtacgagtcnnnn

SEQ ID NO: 12499 - DNA, 20 bp, Artificial Sequence
  Description of Artificial Sequence: Synthetic oligonucleotide
cggactcgtacgagtccgcc

SEQ ID NO: 12500 - DNA, 20 bp, Artificial Sequence
  Description of Artificial Sequence: Synthetic oligonucleotide
cggactcgtacgagtccgct

SEQ ID NO: 12501 - DNA, 20 bp, Artificial Sequence
  Description of Artificial Sequence: Synthetic oligonucleotide
cggactcgtacgagtccgtc

SEQ ID NO: 12502 - DNA, 20 bp, Artificial Sequence
  Description of Artificial Sequence: Synthetic oligonucleotide
aggactcgtacgagtcctcc

SEQ ID NO: 12503 - DNA, 20 bp, Artificial Sequence
  Description of Artificial Sequence: Synthetic oligonucleotide
cagactcgtacgagtctgcc

SEQ ID NO: 12504 - DNA, 20 bp, Artificial Sequence
  Description of Artificial Sequence: Synthetic oligonucleotide
cggactcgtacgagtccgca

SEQ ID NO: 12505 - DNA, 20 bp, Artificial Sequence
  Description of Artificial Sequence: Synthetic oligonucleotide
cggactcgtacgagtccgac

SEQ ID NO: 12506 - DNA, 20 bp, Artificial Sequence
  Description of Artificial Sequence: Synthetic oligonucleotide
tggactcgtacgagtccacc

SEQ ID NO: 12507 - DNA, 20 bp, Artificial Sequence
  Description of Artificial Sequence: Synthetic oligonucleotide
ctgactcgtacgagtcagcc

SEQ ID NO: 12508 - DNA, 20 bp, Artificial Sequence
  Description of Artificial Sequence: Synthetic oligonucleotide
ccgactcgtacgagtcgggc

SEQ ID NO: 12509 - DNA, 20 bp, Artificial Sequence
  Description of Artificial Sequence: Synthetic oligonucleotide
ccgactcgtacgagtcgggt

SEQ ID NO: 12510 - DNA, 20 bp, Artificial Sequence
  Description of Artificial Sequence: Synthetic oligonucleotide
ccgactcgtacgagtcggtc

SEQ ID NO: 12511 - DNA, 20 bp, Artificial Sequence
  Description of Artificial Sequence: Synthetic oligonucleotide
acgactcgtacgagtcgtgc

SEQ ID NO: 12512 - DNA, 20 bp, Artificial Sequence
  Description of Artificial Sequence: Synthetic oligonucleotide
cagactcgtacgagtctggc

SEQ ID NO: 12513 - DNA, 20 bp, Artificial Sequence
  Description of Artificial Sequence: Synthetic oligonucleotide
ccgactcgtacgagtcggga

SEQ ID NO: 12514 - DNA, 20 bp, Artificial Sequence
  Description of Artificial Sequence: Synthetic oligonucleotide
ccgactcgtacgagtcggac

SEQ ID NO: 12515 - DNA, 20 bp, Artificial Sequence
  Description of Artificial Sequence: Synthetic oligonucleotide
ctgactcgtacgagtcaggc

SEQ ID NO: 12516 - DNA, 20 bp, Artificial Sequence
  Description of Artificial Sequence: Synthetic oligonucleotide
gcgactcgtacgagtcgccc

SEQ ID NO: 12517 - DNA, 20 bp, Artificial Sequence
  Description of Artificial Sequence: Synthetic oligonucleotide
gcgactcgtacgagtcgcct

SEQ ID NO: 12518 - DNA, 20 bp, Artificial Sequence
  Description of Artificial Sequence: Synthetic oligonucleotide
gcgactcgtacgagtcgctc

SEQ ID NO: 12519 - DNA, 20 bp, Artificial Sequence
  Description of Artificial Sequence: Synthetic oligonucleotide
acgactcgtacgagtcgtcc

SEQ ID NO: 12520 - DNA, 20 bp, Artificial Sequence
  Description of Artificial Sequence: Synthetic oligonucleotide
gagactcgtacgagtctccc

SEQ ID NO: 12521 - DNA, 20 bp, Artificial Sequence
  Description of Artificial Sequence: Synthetic oligonucleotide
gcgactcgtacgagtcgcca

SEQ ID NO: 12522 - DNA, 20 bp, Artificial Sequence
  Description of Artificial Sequence: Synthetic oligonucleotide
gcgactcgtacgagtcgcac

SEQ ID NO: 12523 - DNA, 20 bp, Artificial Sequence
  Description of Artificial Sequence: Synthetic oligonucleotide
gtgactcgtacgagtcaccc

SEQ ID NO: 12524 - DNA, 20 bp, Artificial Sequence
  Description of Artificial Sequence: Synthetic oligonucleotide
gggactcgtacgagtcccgt

SEQ ID NO: 12525 - DNA, 20 bp, Artificial Sequence
  Description of Artificial Sequence: Synthetic oligonucleotide
gggactcgtacgagtccctg

SEQ ID NO: 12526 - DNA, 20 bp, Artificial Sequence
  Description of Artificial Sequence: Synthetic oligonucleotide
aggactcgtacgagtcctgg

SEQ ID NO: 12527 - DNA, 20 bp, Artificial Sequence
  Description of Artificial Sequence: Synthetic oligonucleotide
gagactcgtacgagtctcgg

SEQ ID NO: 12528 - DNA, 20 bp, Artificial Sequence
  Description of Artificial Sequence: Synthetic oligonucleotide
gggactcgtacgagtcccga

SEQ ID NO: 12529 - DNA, 20 bp, Artificial Sequence
  Description of Artificial Sequence: Synthetic oligonucleotide
gggactcgtacgagtcccag

SEQ ID NO: 12530 - DNA, 20 bp, Artificial Sequence
  Description of Artificial Sequence: Synthetic oligonucleotide
tggactcgtacgagtccagg

SEQ ID NO: 12531 - DNA, 20 bp, Artificial Sequence
  Description of Artificial Sequence: Synthetic oligonucleotide
gtgactcgtacgagtcacgg

SEQ ID NO: 12532 - DNA, 20 bp, Artificial Sequence
  Description of Artificial Sequence: Synthetic oligonucleotide
gcgactcgtacgagtcgccg

SEQ ID NO: 12533 - DNA, 20 bp, Artificial Sequence
  Description of Artificial Sequence: Synthetic oligonucleotide
gcgactcgtacgagtcgctg

SEQ ID NO: 12534 - DNA, 20 bp, Artificial Sequence
  Description of Artificial Sequence: Synthetic oligonucleotide
acgactcgtacgagtcgtcg

SEQ ID NO: 12535 - DNA, 20 bp, Artificial Sequence
  Description of Artificial Sequence: Synthetic oligonucleotide
gagactcgtacgagtctccg

SEQ ID NO: 12536 - DNA, 20 bp, Artificial Sequence
  Description of Artificial Sequence: Synthetic oligonucleotide
gcgactcgtacgagtcgcag

SEQ ID NO: 12537 - DNA, 20 bp, Artificial Sequence
  Description of Artificial Sequence: Synthetic oligonucleotide
gtgactcgtacgagtcaccg

SEQ ID NO: 12538 - DNA, 20 bp, Artificial Sequence
  Description of Artificial Sequence: Synthetic oligonucleotide
cggactcgtacgagtccgtg

SEQ ID NO: 12539 - DNA, 20 bp, Artificial Sequence
  Description of Artificial Sequence: Synthetic oligonucleotide
cagactcgtacgagtctggg

SEQ ID NO: 12540 - DNA, 20 bp, Artificial Sequence
  Description of Artificial Sequence: Synthetic oligonucleotide
cggactcgtacgagtccgag

SEQ ID NO: 12541 - DNA, 20 bp, Artificial Sequence
  Description of Artificial Sequence: Synthetic oligonucleotide
ctgactcgtacgagtcaggg

SEQ ID NO: 12542 - DNA, 20 bp, Artificial Sequence
  Description of Artificial Sequence: Synthetic oligonucleotide
acgactcgtacgagtcgtgg

SEQ ID NO: 12543 - DNA, 20 bp, Artificial Sequence
  Description of Artificial Sequence: Synthetic oligonucleotide
ccgactcgtacgagtcggct

SEQ ID NO: 12544 - DNA, 20 bp, Artificial Sequence
  Description of Artificial Sequence: Synthetic oligonucleotide
ccgactcgtacgagtcggca

SEQ ID NO: 12545 - DNA, 20 bp, Artificial Sequence
  Description of Artificial Sequence: Synthetic oligonucleotide
gagactcgtacgagtctcgc

SEQ ID NO: 12546 - DNA, 20 bp, Artificial Sequence
  Description of Artificial Sequence: Synthetic oligonucleotide
gtgactcgtacgagtcacgc

SEQ ID NO: 12547 - DNA, 20 bp, Artificial Sequence
  Description of Artificial Sequence: Synthetic oligonucleotide
aggactcgtacgagtcctgc

SEQ ID NO: 12548 - DNA, 20 bp, Artificial Sequence
  Description of Artificial Sequence: Synthetic oligonucleotide
tggactcgtacgagtccagc

SEQ ID NO: 12549 - DNA, 20 bp, Artificial Sequence
  Description of Artificial Sequence: Synthetic oligonucleotide
aggactcgtacgagtcctcg

SEQ ID NO: 12550 - DNA, 20 bp, Artificial Sequence
  Description of Artificial Sequence: Synthetic oligonucleotide
tggactcgtacgagtccacg

SEQ ID NO: 12551 - DNA, 20 bp, Artificial Sequence
  Description of Artificial Sequence: Synthetic oligonucleotide
ccgactcgtacgagtcggtg

SEQ ID NO: 12552 - DNA, 20 bp, Artificial Sequence
  Description of Artificial Sequence: Synthetic oligonucleotide
ccgactcgtacgagtcggag

SEQ ID NO: 12553 - DNA, 20 bp, Artificial Sequence
  Description of Artificial Sequence: Synthetic oligonucleotide
gggactcgtacgagtcccgc

SEQ ID NO: 12554 - DNA, 20 bp, Artificial Sequence
  Description of Artificial Sequence: Synthetic oligonucleotide
gggactcgtacgagtccctc

SEQ ID NO: 12555 - DNA, 20 bp, Artificial Sequence
  Description of Artificial Sequence: Synthetic oligonucleotide
gggactcgtacgagtcccac

SEQ ID NO: 12556 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcctaggagtcnnnn

SEQ ID NO: 12557 - DNA, 20 bp, Artificial Sequence
  Description of Artificial Sequence: Synthetic oligonucleotide
cggactcctaggagtccgcc

SEQ ID NO: 12558 - DNA, 20 bp, Artificial Sequence
  Description of Artificial Sequence: Synthetic oligonucleotide
cggactcctaggagtccgct

SEQ ID NO: 12559 - DNA, 20 bp, Artificial Sequence
  Description of Artificial Sequence: Synthetic oligonucleotide
cggactcctaggagtccgtc

SEQ ID NO: 12560 - DNA, 20 bp, Artificial Sequence
  Description of Artificial Sequence: Synthetic oligonucleotide
aggactcctaggagtcctcc

SEQ ID NO: 12561 - DNA, 20 bp, Artificial Sequence
  Description of Artificial Sequence: Synthetic oligonucleotide
cagactcctaggagtctgcc

SEQ ID NO: 12562 - DNA, 20 bp, Artificial Sequence
  Description of Artificial Sequence: Synthetic oligonucleotide
cggactcctaggagtccgca

SEQ ID NO: 12563 - DNA, 20 bp, Artificial Sequence
  Description of Artificial Sequence: Synthetic oligonucleotide
cggactcctaggagtccgac

SEQ ID NO: 12564 - DNA, 20 bp, Artificial Sequence
  Description of Artificial Sequence: Synthetic oligonucleotide
tggactcctaggagtccacc

SEQ ID NO: 12565 - DNA, 20 bp, Artificial Sequence
  Description of Artificial Sequence: Synthetic oligonucleotide
ctgactcctaggagtcagcc

SEQ ID NO: 12566 - DNA, 20 bp, Artificial Sequence
  Description of Artificial Sequence: Synthetic oligonucleotide
ccgactcctaggagtcgggc

SEQ ID NO: 12567 - DNA, 20 bp, Artificial Sequence
  Description of Artificial Sequence: Synthetic oligonucleotide
ccgactcctaggagtcgggt

SEQ ID NO: 12568 - DNA, 20 bp, Artificial Sequence
  Description of Artificial Sequence: Synthetic oligonucleotide
ccgactcctaggagtcggtc

SEQ ID NO: 12569 - DNA, 20 bp, Artificial Sequence
  Description of Artificial Sequence: Synthetic oligonucleotide
acgactcctaggagtcgtgc

SEQ ID NO: 12570 - DNA, 20 bp, Artificial Sequence
  Description of Artificial Sequence: Synthetic oligonucleotide
cagactcctaggagtctggc

SEQ ID NO: 12571 - DNA, 20 bp, Artificial Sequence
  Description of Artificial Sequence: Synthetic oligonucleotide
ccgactcctaggagtcggga

SEQ ID NO: 12572 - DNA, 20 bp, Artificial Sequence
  Description of Artificial Sequence: Synthetic oligonucleotide
ccgactcctaggagtcggac

SEQ ID NO: 12573 - DNA, 20 bp, Artificial Sequence
  Description of Artificial Sequence: Synthetic oligonucleotide
ctgactcctaggagtcaggc

SEQ ID NO: 12574 - DNA, 20 bp, Artificial Sequence
  Description of Artificial Sequence: Synthetic oligonucleotide
gcgactcctaggagtcgccc

SEQ ID NO: 12575 - DNA, 20 bp, Artificial Sequence
  Description of Artificial Sequence: Synthetic oligonucleotide
gcgactcctaggagtcgcct

SEQ ID NO: 12576 - DNA, 20 bp, Artificial Sequence
  Description of Artificial Sequence: Synthetic oligonucleotide
gcgactcctaggagtcgctc

SEQ ID NO: 12577 - DNA, 20 bp, Artificial Sequence
  Description of Artificial Sequence: Synthetic oligonucleotide
acgactcctaggagtcgtcc

SEQ ID NO: 12578 - DNA, 20 bp, Artificial Sequence
  Description of Artificial Sequence: Synthetic oligonucleotide
gagactcctaggagtctccc

SEQ ID NO: 12579 - DNA, 20 bp, Artificial Sequence
  Description of Artificial Sequence: Synthetic oligonucleotide
gcgactcctaggagtcgcca

SEQ ID NO: 12580 - DNA, 20 bp, Artificial Sequence
  Description of Artificial Sequence: Synthetic oligonucleotide
gcgactcctaggagtcgcac

SEQ ID NO: 12581 - DNA, 20 bp, Artificial Sequence
  Description of Artificial Sequence: Synthetic oligonucleotide
gtgactcctaggagtcaccc

SEQ ID NO: 12582 - DNA, 20 bp, Artificial Sequence
  Description of Artificial Sequence: Synthetic oligonucleotide
gggactcctaggagtcccgt

SEQ ID NO: 12583 - DNA, 20 bp, Artificial Sequence
  Description of Artificial Sequence: Synthetic oligonucleotide
gggactcctaggagtccctg

SEQ ID NO: 12584 - DNA, 20 bp, Artificial Sequence
  Description of Artificial Sequence: Synthetic oligonucleotide
aggactcctaggagtcctgg

SEQ ID NO: 12585 - DNA, 20 bp, Artificial Sequence
  Description of Artificial Sequence: Synthetic oligonucleotide
gagactcctaggagtctcgg

SEQ ID NO: 12586 - DNA, 20 bp, Artificial Sequence
  Description of Artificial Sequence: Synthetic oligonucleotide
gggactcctaggagtcccga

SEQ ID NO: 12587 - DNA, 20 bp, Artificial Sequence
  Description of Artificial Sequence: Synthetic oligonucleotide
gggactcctaggagtcccag

SEQ ID NO: 12588 - DNA, 20 bp, Artificial Sequence
  Description of Artificial Sequence: Synthetic oligonucleotide
tggactcctaggagtccagg

SEQ ID NO: 12589 - DNA, 20 bp, Artificial Sequence
  Description of Artificial Sequence: Synthetic oligonucleotide
gtgactcctaggagtcacgg

SEQ ID NO: 12590 - DNA, 20 bp, Artificial Sequence
  Description of Artificial Sequence: Synthetic oligonucleotide
gcgactcctaggagtcgccg

SEQ ID NO: 12591 - DNA, 20 bp, Artificial Sequence
  Description of Artificial Sequence: Synthetic oligonucleotide
gcgactcctaggagtcgctg

SEQ ID NO: 12592 - DNA, 20 bp, Artificial Sequence
  Description of Artificial Sequence: Synthetic oligonucleotide
acgactcctaggagtcgtcg

SEQ ID NO: 12593 - DNA, 20 bp, Artificial Sequence
  Description of Artificial Sequence: Synthetic oligonucleotide
gagactcctaggagtctccg

SEQ ID NO: 12594 - DNA, 20 bp, Artificial Sequence
  Description of Artificial Sequence: Synthetic oligonucleotide
gcgactcctaggagtcgcag

SEQ ID NO: 12595 - DNA, 20 bp, Artificial Sequence
  Description of Artificial Sequence: Synthetic oligonucleotide
gtgactcctaggagtcaccg

SEQ ID NO: 12596 - DNA, 20 bp, Artificial Sequence
  Description of Artificial Sequence: Synthetic oligonucleotide
cggactcctaggagtccgtg

SEQ ID NO: 12597 - DNA, 20 bp, Artificial Sequence
  Description of Artificial Sequence: Synthetic oligonucleotide
cagactcctaggagtctggg

SEQ ID NO: 12598 - DNA, 20 bp, Artificial Sequence
  Description of Artificial Sequence: Synthetic oligonucleotide
cggactcctaggagtccgag

SEQ ID NO: 12599 - DNA, 20 bp, Artificial Sequence
  Description of Artificial Sequence: Synthetic oligonucleotide
ctgactcctaggagtcaggg

SEQ ID NO: 12600 - DNA, 20 bp, Artificial Sequence
  Description of Artificial Sequence: Synthetic oligonucleotide
acgactcctaggagtcgtgg

SEQ ID NO: 12601 - DNA, 20 bp, Artificial Sequence
  Description of Artificial Sequence: Synthetic oligonucleotide
ccgactcctaggagtcggct

SEQ ID NO: 12602 - DNA, 20 bp, Artificial Sequence
  Description of Artificial Sequence: Synthetic oligonucleotide
ccgactcctaggagtcggca

SEQ ID NO: 12603 - DNA, 20 bp, Artificial Sequence
  Description of Artificial Sequence: Synthetic oligonucleotide
gagactcctaggagtctcgc

SEQ ID NO: 12604 - DNA, 20 bp, Artificial Sequence
  Description of Artificial Sequence: Synthetic oligonucleotide
gtgactcctaggagtcacgc

SEQ ID NO: 12605 - DNA, 20 bp, Artificial Sequence
  Description of Artificial Sequence: Synthetic oligonucleotide
aggactcctaggagtcctgc

SEQ ID NO: 12606 - DNA, 20 bp, Artificial Sequence
  Description of Artificial Sequence: Synthetic oligonucleotide
tggactcctaggagtccagc

SEQ ID NO: 12607 - DNA, 20 bp, Artificial Sequence
  Description of Artificial Sequence: Synthetic oligonucleotide
aggactcctaggagtcctcg

SEQ ID NO: 12608 - DNA, 20 bp, Artificial Sequence
  Description of Artificial Sequence: Synthetic oligonucleotide
tggactcctaggagtccacg

SEQ ID NO: 12609 - DNA, 20 bp, Artificial Sequence
  Description of Artificial Sequence: Synthetic oligonucleotide
ccgactcctaggagtcggtg

SEQ ID NO: 12610 - DNA, 20 bp, Artificial Sequence
  Description of Artificial Sequence: Synthetic oligonucleotide
ccgactcctaggagtcggag

SEQ ID NO: 12611 - DNA, 20 bp, Artificial Sequence
  Description of Artificial Sequence: Synthetic oligonucleotide
gggactcctaggagtcccgc

SEQ ID NO: 12612 - DNA, 20 bp, Artificial Sequence
  Description of Artificial Sequence: Synthetic oligonucleotide
gggactcctaggagtccctc

SEQ ID NO: 12613 - DNA, 20 bp, Artificial Sequence
  Description of Artificial Sequence: Synthetic oligonucleotide
gggactcctaggagtcccac

SEQ ID NO: 12614 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactccatggagtcnnnn

SEQ ID NO: 12615 - DNA, 20 bp, Artificial Sequence
  Description of Artificial Sequence: Synthetic oligonucleotide
cggactccatggagtccgcc

SEQ ID NO: 12616 - DNA, 20 bp, Artificial Sequence
  Description of Artificial Sequence: Synthetic oligonucleotide
cggactccatggagtccgct

SEQ ID NO: 12617 - DNA, 20 bp, Artificial Sequence
  Description of Artificial Sequence: Synthetic oligonucleotide
cggactccatggagtccgtc

SEQ ID NO: 12618 - DNA, 20 bp, Artificial Sequence
  Description of Artificial Sequence: Synthetic oligonucleotide
aggactccatggagtcctcc

SEQ ID NO: 12619 - DNA, 20 bp, Artificial Sequence
  Description of Artificial Sequence: Synthetic oligonucleotide
cagactccatggagtctgcc

SEQ ID NO: 12620 - DNA, 20 bp, Artificial Sequence
  Description of Artificial Sequence: Synthetic oligonucleotide
cggactccatggagtccgca

SEQ ID NO: 12621 - DNA, 20 bp, Artificial Sequence
  Description of Artificial Sequence: Synthetic oligonucleotide
cggactccatggagtccgac

SEQ ID NO: 12622 - DNA, 20 bp, Artificial Sequence
  Description of Artificial Sequence: Synthetic oligonucleotide
tggactccatggagtccacc

SEQ ID NO: 12623 - DNA, 20 bp, Artificial Sequence
  Description of Artificial Sequence: Synthetic oligonucleotide
ctgactccatggagtcagcc

SEQ ID NO: 12624 - DNA, 20 bp, Artificial Sequence
  Description of Artificial Sequence: Synthetic oligonucleotide
ccgactccatggagtcgggc

SEQ ID NO: 12625 - DNA, 20 bp, Artificial Sequence
  Description of Artificial Sequence: Synthetic oligonucleotide
ccgactccatggagtcgggt

SEQ ID NO: 12626 - DNA, 20 bp, Artificial Sequence
  Description of Artificial Sequence: Synthetic oligonucleotide
ccgactccatggagtcggtc

SEQ ID NO: 12627 - DNA, 20 bp, Artificial Sequence
  Description of Artificial Sequence: Synthetic oligonucleotide
acgactccatggagtcgtgc

SEQ ID NO: 12628 - DNA, 20 bp, Artificial Sequence
  Description of Artificial Sequence: Synthetic oligonucleotide
cagactccatggagtctggc

SEQ ID NO: 12629 - DNA, 20 bp, Artificial Sequence
  Description of Artificial Sequence: Synthetic oligonucleotide
ccgactccatggagtcggga

SEQ ID NO: 12630 - DNA, 20 bp, Artificial Sequence
  Description of Artificial Sequence: Synthetic oligonucleotide
ccgactccatggagtcggac

SEQ ID NO: 12631 - DNA, 20 bp, Artificial Sequence
  Description of Artificial Sequence: Synthetic oligonucleotide
ctgactccatggagtcaggc

SEQ ID NO: 12632 - DNA, 20 bp, Artificial Sequence
  Description of Artificial Sequence: Synthetic oligonucleotide
gcgactccatggagtcgccc

SEQ ID NO: 12633 - DNA, 20 bp, Artificial Sequence
  Description of Artificial Sequence: Synthetic oligonucleotide
gcgactccatggagtcgcct

SEQ ID NO: 12634 - DNA, 20 bp, Artificial Sequence
  Description of Artificial Sequence: Synthetic oligonucleotide
gcgactccatggagtcgctc

SEQ ID NO: 12635 - DNA, 20 bp, Artificial Sequence
  Description of Artificial Sequence: Synthetic oligonucleotide
acgactccatggagtcgtcc

SEQ ID NO: 12636 - DNA, 20 bp, Artificial Sequence
  Description of Artificial Sequence: Synthetic oligonucleotide
gagactccatggagtctccc

SEQ ID NO: 12637 - DNA, 20 bp, Artificial Sequence
  Description of Artificial Sequence: Synthetic oligonucleotide
gcgactccatggagtcgcca

SEQ ID NO: 12638 - DNA, 20 bp, Artificial Sequence
  Description of Artificial Sequence: Synthetic oligonucleotide
gcgactccatggagtcgcac

SEQ ID NO: 12639 - DNA, 20 bp, Artificial Sequence
  Description of Artificial Sequence: Synthetic oligonucleotide
gtgactccatggagtcaccc

SEQ ID NO: 12640 - DNA, 20 bp, Artificial Sequence
  Description of Artificial Sequence: Synthetic oligonucleotide
gggactccatggagtcccgt

SEQ ID NO: 12641 - DNA, 20 bp, Artificial Sequence
  Description of Artificial Sequence: Synthetic oligonucleotide
gggactccatggagtccctg

SEQ ID NO: 12642 - DNA, 20 bp, Artificial Sequence
  Description of Artificial Sequence: Synthetic oligonucleotide
aggactccatggagtcctgg

SEQ ID NO: 12643 - DNA, 20 bp, Artificial Sequence
  Description of Artificial Sequence: Synthetic oligonucleotide
gagactccatggagtctcgg

SEQ ID NO: 12644 - DNA, 20 bp, Artificial Sequence
  Description of Artificial Sequence: Synthetic oligonucleotide
gggactccatggagtcccga

SEQ ID NO: 12645 - DNA, 20 bp, Artificial Sequence
  Description of Artificial Sequence: Synthetic oligonucleotide
gggactccatggagtcccag

SEQ ID NO: 12646 - DNA, 20 bp, Artificial Sequence
  Description of Artificial Sequence: Synthetic oligonucleotide
tggactccatggagtccagg

SEQ ID NO: 12647 - DNA, 20 bp, Artificial Sequence
  Description of Artificial Sequence: Synthetic oligonucleotide
gtgactccatggagtcacgg

SEQ ID NO: 12648 - DNA, 20 bp, Artificial Sequence
  Description of Artificial Sequence: Synthetic oligonucleotide
gcgactccatggagtcgccg

SEQ ID NO: 12649 - DNA, 20 bp, Artificial Sequence
  Description of Artificial Sequence: Synthetic oligonucleotide
gcgactccatggagtcgctg

SEQ ID NO: 12650 - DNA, 20 bp, Artificial Sequence
  Description of Artificial Sequence: Synthetic oligonucleotide
acgactccatggagtcgtcg

SEQ ID NO: 12651 - DNA, 20 bp, Artificial Sequence
  Description of Artificial Sequence: Synthetic oligonucleotide
gagactccatggagtctccg

SEQ ID NO: 12652 - DNA, 20 bp, Artificial Sequence
  Description of Artificial Sequence: Synthetic oligonucleotide
gcgactccatggagtcgcag

SEQ ID NO: 12653 - DNA, 20 bp, Artificial Sequence
  Description of Artificial Sequence: Synthetic oligonucleotide
gtgactccatggagtcaccg

SEQ ID NO: 12654 - DNA, 20 bp, Artificial Sequence
  Description of Artificial Sequence: Synthetic oligonucleotide
cggactccatggagtccgtg

SEQ ID NO: 12655 - DNA, 20 bp, Artificial Sequence
  Description of Artificial Sequence: Synthetic oligonucleotide
cagactccatggagtctggg

SEQ ID NO: 12656 - DNA, 20 bp, Artificial Sequence
  Description of Artificial Sequence: Synthetic oligonucleotide
cggactccatggagtccgag

SEQ ID NO: 12657 - DNA, 20 bp, Artificial Sequence
  Description of Artificial Sequence: Synthetic oligonucleotide
ctgactccatggagtcaggg

SEQ ID NO: 12658 - DNA, 20 bp, Artificial Sequence
  Description of Artificial Sequence: Synthetic oligonucleotide
acgactccatggagtcgtgg

SEQ ID NO: 12659 - DNA, 20 bp, Artificial Sequence
  Description of Artificial Sequence: Synthetic oligonucleotide
ccgactccatggagtcggct

SEQ ID NO: 12660 - DNA, 20 bp, Artificial Sequence
  Description of Artificial Sequence: Synthetic oligonucleotide
ccgactccatggagtcggca

SEQ ID NO: 12661 - DNA, 20 bp, Artificial Sequence
  Description of Artificial Sequence: Synthetic oligonucleotide
gagactccatggagtctcgc

SEQ ID NO: 12662 - DNA, 20 bp, Artificial Sequence
  Description of Artificial Sequence: Synthetic oligonucleotide
gtgactccatggagtcacgc

SEQ ID NO: 12663 - DNA, 20 bp, Artificial Sequence
  Description of Artificial Sequence: Synthetic oligonucleotide
aggactccatggagtcctgc

SEQ ID NO: 12664 - DNA, 20 bp, Artificial Sequence
  Description of Artificial Sequence: Synthetic oligonucleotide
tggactccatggagtccagc

SEQ ID NO: 12665 - DNA, 20 bp, Artificial Sequence
  Description of Artificial Sequence: Synthetic oligonucleotide
aggactccatggagtcctcg

SEQ ID NO: 12666 - DNA, 20 bp, Artificial Sequence
  Description of Artificial Sequence: Synthetic oligonucleotide
tggactccatggagtccacg

SEQ ID NO: 12667 - DNA, 20 bp, Artificial Sequence
  Description of Artificial Sequence: Synthetic oligonucleotide
ccgactccatggagtcggtg

SEQ ID NO: 12668 - DNA, 20 bp, Artificial Sequence
  Description of Artificial Sequence: Synthetic oligonucleotide
ccgactccatggagtcggag

SEQ ID NO: 12669 - DNA, 20 bp, Artificial Sequence
  Description of Artificial Sequence: Synthetic oligonucleotide
gggactccatggagtcccgc

SEQ ID NO: 12670 - DNA, 20 bp, Artificial Sequence
  Description of Artificial Sequence: Synthetic oligonucleotide
gggactccatggagtccctc

SEQ ID NO: 12671 - DNA, 20 bp, Artificial Sequence
  Description of Artificial Sequence: Synthetic oligonucleotide
gggactccatggagtcccac

SEQ ID NO: 12672 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactctcgagagtcnnnn

SEQ ID NO: 12673 - DNA, 20 bp, Artificial Sequence
  Description of Artificial Sequence: Synthetic oligonucleotide
cggactctcgagagtccgcc

SEQ ID NO: 12674 - DNA, 20 bp, Artificial Sequence
  Description of Artificial Sequence: Synthetic oligonucleotide
cggactctcgagagtccgct

SEQ ID NO: 12675 - DNA, 20 bp, Artificial Sequence
  Description of Artificial Sequence: Synthetic oligonucleotide
cggactctcgagagtccgtc

SEQ ID NO: 12676 - DNA, 20 bp, Artificial Sequence
  Description of Artificial Sequence: Synthetic oligonucleotide
aggactctcgagagtcctcc

SEQ ID NO: 12677 - DNA, 20 bp, Artificial Sequence
  Description of Artificial Sequence: Synthetic oligonucleotide
cagactctcgagagtctgcc

SEQ ID NO: 12678 - DNA, 20 bp, Artificial Sequence
  Description of Artificial Sequence: Synthetic oligonucleotide
cggactctcgagagtccgca

SEQ ID NO: 12679 - DNA, 20 bp, Artificial Sequence
  Description of Artificial Sequence: Synthetic oligonucleotide
cggactctcgagagtccgac

SEQ ID NO: 12680 - DNA, 20 bp, Artificial Sequence
  Description of Artificial Sequence: Synthetic oligonucleotide
tggactctcgagagtccacc

SEQ ID NO: 12681 - DNA, 20 bp, Artificial Sequence
  Description of Artificial Sequence: Synthetic oligonucleotide
ctgactctcgagagtcagcc

SEQ ID NO: 12682 - DNA, 20 bp, Artificial Sequence
  Description of Artificial Sequence: Synthetic oligonucleotide
ccgactctcgagagtcgggc

SEQ ID NO: 12683 - DNA, 20 bp, Artificial Sequence
  Description of Artificial Sequence: Synthetic oligonucleotide
ccgactctcgagagtcgggt

SEQ ID NO: 12684 - DNA, 20 bp, Artificial Sequence
  Description of Artificial Sequence: Synthetic oligonucleotide
ccgactctcgagagtcggtc

SEQ ID NO: 12685 - DNA, 20 bp, Artificial Sequence
  Description of Artificial Sequence: Synthetic oligonucleotide
acgactctcgagagtcgtgc

SEQ ID NO: 12686 - DNA, 20 bp, Artificial Sequence
  Description of Artificial Sequence: Synthetic oligonucleotide
cagactctcgagagtctggc

SEQ ID NO: 12687 - DNA, 20 bp, Artificial Sequence
  Description of Artificial Sequence: Synthetic oligonucleotide
ccgactctcgagagtcggga

SEQ ID NO: 12688 - DNA, 20 bp, Artificial Sequence
  Description of Artificial Sequence: Synthetic oligonucleotide
ccgactctcgagagtcggac

SEQ ID NO: 12689 - DNA, 20 bp, Artificial Sequence
  Description of Artificial Sequence: Synthetic oligonucleotide
ctgactctcgagagtcaggc

SEQ ID NO: 12690 - DNA, 20 bp, Artificial Sequence
  Description of Artificial Sequence: Synthetic oligonucleotide
gcgactctcgagagtcgccc

SEQ ID NO: 12691 - DNA, 20 bp, Artificial Sequence
  Description of Artificial Sequence: Synthetic oligonucleotide
gcgactctcgagagtcgcct

SEQ ID NO: 12692 - DNA, 20 bp, Artificial Sequence
  Description of Artificial Sequence: Synthetic oligonucleotide
gcgactctcgagagtcgctc

SEQ ID NO: 12693 - DNA, 20 bp, Artificial Sequence
  Description of Artificial Sequence: Synthetic oligonucleotide
acgactctcgagagtcgtcc

SEQ ID NO: 12694 - DNA, 20 bp, Artificial Sequence
  Description of Artificial Sequence: Synthetic oligonucleotide
gagactctcgagagtctccc

SEQ ID NO: 12695 - DNA, 20 bp, Artificial Sequence
  Description of Artificial Sequence: Synthetic oligonucleotide
gcgactctcgagagtcgcca

SEQ ID NO: 12696 - DNA, 20 bp, Artificial Sequence
  Description of Artificial Sequence: Synthetic oligonucleotide
gcgactctcgagagtcgcac

SEQ ID NO: 12697 - DNA, 20 bp, Artificial Sequence
  Description of Artificial Sequence: Synthetic oligonucleotide
gtgactctcgagagtcaccc

SEQ ID NO: 12698 - DNA, 20 bp, Artificial Sequence
  Description of Artificial Sequence: Synthetic oligonucleotide
gggactctcgagagtcccgt

SEQ ID NO: 12699 - DNA, 20 bp, Artificial Sequence
  Description of Artificial Sequence: Synthetic oligonucleotide
gggactctcgagagtccctg

SEQ ID NO: 12700 - DNA, 20 bp, Artificial Sequence
  Description of Artificial Sequence: Synthetic oligonucleotide
aggactctcgagagtcctgg

SEQ ID NO: 12701 - DNA, 20 bp, Artificial Sequence
  Description of Artificial Sequence: Synthetic oligonucleotide
gagactctcgagagtctcgg

SEQ ID NO: 12702 - DNA, 20 bp, Artificial Sequence
  Description of Artificial Sequence: Synthetic oligonucleotide
gggactctcgagagtcccga

SEQ ID NO: 12703 - DNA, 20 bp, Artificial Sequence
  Description of Artificial Sequence: Synthetic oligonucleotide
gggactctcgagagtcccag

SEQ ID NO: 12704 - DNA, 20 bp, Artificial Sequence
  Description of Artificial Sequence: Synthetic oligonucleotide
tggactctcgagagtccagg

SEQ ID NO: 12705 - DNA, 20 bp, Artificial Sequence
  Description of Artificial Sequence: Synthetic oligonucleotide
gtgactctcgagagtcacgg

SEQ ID NO: 12706 - DNA, 20 bp, Artificial Sequence
  Description of Artificial Sequence: Synthetic oligonucleotide
gcgactctcgagagtcgccg

SEQ ID NO: 12707 - DNA, 20 bp, Artificial Sequence
  Description of Artificial Sequence: Synthetic oligonucleotide
gcgactctcgagagtcgctg

SEQ ID NO: 12708 - DNA, 20 bp, Artificial Sequence
  Description of Artificial Sequence: Synthetic oligonucleotide
acgactctcgagagtcgtcg

SEQ ID NO: 12709 - DNA, 20 bp, Artificial Sequence
  Description of Artificial Sequence: Synthetic oligonucleotide
gagactctcgagagtctccg

SEQ ID NO: 12710 - DNA, 20 bp, Artificial Sequence
  Description of Artificial Sequence: Synthetic oligonucleotide
gcgactctcgagagtcgcag

SEQ ID NO: 12711 - DNA, 20 bp, Artificial Sequence
  Description of Artificial Sequence: Synthetic oligonucleotide
gtgactctcgagagtcaccg

SEQ ID NO: 12712 - DNA, 20 bp, Artificial Sequence
  Description of Artificial Sequence: Synthetic oligonucleotide
cggactctcgagagtccgtg

SEQ ID NO: 12713 - DNA, 20 bp, Artificial Sequence
  Description of Artificial Sequence: Synthetic oligonucleotide
cagactctcgagagtctggg

SEQ ID NO: 12714 - DNA, 20 bp, Artificial Sequence
  Description of Artificial Sequence: Synthetic oligonucleotide
cggactctcgagagtccgag

SEQ ID NO: 12715 - DNA, 20 bp, Artificial Sequence
  Description of Artificial Sequence: Synthetic oligonucleotide
ctgactctcgagagtcaggg

SEQ ID NO: 12716 - DNA, 20 bp, Artificial Sequence
  Description of Artificial Sequence: Synthetic oligonucleotide
acgactctcgagagtcgtgg

SEQ ID NO: 12717 - DNA, 20 bp, Artificial Sequence
  Description of Artificial Sequence: Synthetic oligonucleotide
ccgactctcgagagtcggct

SEQ ID NO: 12718 - DNA, 20 bp, Artificial Sequence
  Description of Artificial Sequence: Synthetic oligonucleotide
ccgactctcgagagtcggca

SEQ ID NO: 12719 - DNA, 20 bp, Artificial Sequence
  Description of Artificial Sequence: Synthetic oligonucleotide
gagactctcgagagtctcgc

SEQ ID NO: 12720 - DNA, 20 bp, Artificial Sequence
  Description of Artificial Sequence: Synthetic oligonucleotide
gtgactctcgagagtcacgc

SEQ ID NO: 12721 - DNA, 20 bp, Artificial Sequence
  Description of Artificial Sequence: Synthetic oligonucleotide
aggactctcgagagtcctgc

SEQ ID NO: 12722 - DNA, 20 bp, Artificial Sequence
  Description of Artificial Sequence: Synthetic oligonucleotide
tggactctcgagagtccagc

SEQ ID NO: 12723 - DNA, 20 bp, Artificial Sequence
  Description of Artificial Sequence: Synthetic oligonucleotide
aggactctcgagagtcctcg

SEQ ID NO: 12724 - DNA, 20 bp, Artificial Sequence
  Description of Artificial Sequence: Synthetic oligonucleotide
tggactctcgagagtccacg

SEQ ID NO: 12725 - DNA, 20 bp, Artificial Sequence
  Description of Artificial Sequence: Synthetic oligonucleotide
ccgactctcgagagtcggtg

SEQ ID NO: 12726 - DNA, 20 bp, Artificial Sequence
  Description of Artificial Sequence: Synthetic oligonucleotide
ccgactctcgagagtcggag

SEQ ID NO: 12727 - DNA, 20 bp, Artificial Sequence
  Description of Artificial Sequence: Synthetic oligonucleotide
gggactctcgagagtcccgc

SEQ ID NO: 12728 - DNA, 20 bp, Artificial Sequence
  Description of Artificial Sequence: Synthetic oligonucleotide
gggactctcgagagtccctc

SEQ ID NO: 12729 - DNA, 20 bp, Artificial Sequence
  Description of Artificial Sequence: Synthetic oligonucleotide
gggactctcgagagtcccac

SEQ ID NO: 12730 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcagctgagtcnnnn

SEQ ID NO: 12731 - DNA, 20 bp, Artificial Sequence
  Description of Artificial Sequence: Synthetic oligonucleotide
cggactcagctgagtccgcc

SEQ ID NO: 12732 - DNA, 20 bp, Artificial Sequence
  Description of Artificial Sequence: Synthetic oligonucleotide
cggactcagctgagtccgct

SEQ ID NO: 12733 - DNA, 20 bp, Artificial Sequence
  Description of Artificial Sequence: Synthetic oligonucleotide
cggactcagctgagtccgtc

SEQ ID NO: 12734 - DNA, 20 bp, Artificial Sequence
  Description of Artificial Sequence: Synthetic oligonucleotide
aggactcagctgagtcctcc

SEQ ID NO: 12735 - DNA, 20 bp, Artificial Sequence
  Description of Artificial Sequence: Synthetic oligonucleotide
cagactcagctgagtctgcc

SEQ ID NO: 12736 - DNA, 20 bp, Artificial Sequence
  Description of Artificial Sequence: Synthetic oligonucleotide
cggactcagctgagtccgca

SEQ ID NO: 12737 - DNA, 20 bp, Artificial Sequence
  Description of Artificial Sequence: Synthetic oligonucleotide
cggactcagctgagtccgac

SEQ ID NO: 12738 - DNA, 20 bp, Artificial Sequence
  Description of Artificial Sequence: Synthetic oligonucleotide
tggactcagctgagtccacc

SEQ ID NO: 12739 - DNA, 20 bp, Artificial Sequence
  Description of Artificial Sequence: Synthetic oligonucleotide
ctgactcagctgagtcagcc

SEQ ID NO: 12740 - DNA, 20 bp, Artificial Sequence
  Description of Artificial Sequence: Synthetic oligonucleotide
ccgactcagctgagtcgggc

SEQ ID NO: 12741 - DNA, 20 bp, Artificial Sequence
  Description of Artificial Sequence: Synthetic oligonucleotide
ccgactcagctgagtcgggt

SEQ ID NO: 12742 - DNA, 20 bp, Artificial Sequence
  Description of Artificial Sequence: Synthetic oligonucleotide
ccgactcagctgagtcggtc

SEQ ID NO: 12743 - DNA, 20 bp, Artificial Sequence
  Description of Artificial Sequence: Synthetic oligonucleotide
acgactcagctgagtcgtgc

SEQ ID NO: 12744 - DNA, 20 bp, Artificial Sequence
  Description of Artificial Sequence: Synthetic oligonucleotide
cagactcagctgagtctggc

SEQ ID NO: 12745 - DNA, 20 bp, Artificial Sequence
  Description of Artificial Sequence: Synthetic oligonucleotide
ccgactcagctgagtcggga

SEQ ID NO: 12746 - DNA, 20 bp, Artificial Sequence
  Description of Artificial Sequence: Synthetic oligonucleotide
ccgactcagctgagtcggac

SEQ ID NO: 12747 - DNA, 20 bp, Artificial Sequence
  Description of Artificial Sequence: Synthetic oligonucleotide
ctgactcagctgagtcaggc

SEQ ID NO: 12748 - DNA, 20 bp, Artificial Sequence
  Description of Artificial Sequence: Synthetic oligonucleotide
gcgactcagctgagtcgccc

SEQ ID NO: 12749 - DNA, 20 bp, Artificial Sequence
  Description of Artificial Sequence: Synthetic oligonucleotide
gcgactcagctgagtcgcct

SEQ ID NO: 12750 - DNA, 20 bp, Artificial Sequence
  Description of Artificial Sequence: Synthetic oligonucleotide
gcgactcagctgagtcgctc

SEQ ID NO: 12751 - DNA, 20 bp, Artificial Sequence
  Description of Artificial Sequence: Synthetic oligonucleotide
acgactcagctgagtcgtcc

SEQ ID NO: 12752 - DNA, 20 bp, Artificial Sequence
  Description of Artificial Sequence: Synthetic oligonucleotide
gagactcagctgagtctccc

SEQ ID NO: 12753 - DNA, 20 bp, Artificial Sequence
  Description of Artificial Sequence: Synthetic oligonucleotide
gcgactcagctgagtcgcca

SEQ ID NO: 12754 - DNA, 20 bp, Artificial Sequence
  Description of Artificial Sequence: Synthetic oligonucleotide
gcgactcagctgagtcgcac

SEQ ID NO: 12755 - DNA, 20 bp, Artificial Sequence
  Description of Artificial Sequence: Synthetic oligonucleotide
gtgactcagctgagtcaccc

SEQ ID NO: 12756 - DNA, 20 bp, Artificial Sequence
  Description of Artificial Sequence: Synthetic oligonucleotide
gggactcagctgagtcccgt

SEQ ID NO: 12757 - DNA, 20 bp, Artificial Sequence
  Description of Artificial Sequence: Synthetic oligonucleotide
gggactcagctgagtccctg

SEQ ID NO: 12758 - DNA, 20 bp, Artificial Sequence
  Description of Artificial Sequence: Synthetic oligonucleotide
aggactcagctgagtcctgg

SEQ ID NO: 12759 - DNA, 20 bp, Artificial Sequence
  Description of Artificial Sequence: Synthetic oligonucleotide
gagactcagctgagtctcgg

SEQ ID NO: 12760 - DNA, 20 bp, Artificial Sequence
  Description of Artificial Sequence: Synthetic oligonucleotide
gggactcagctgagtcccga

SEQ ID NO: 12761 - DNA, 20 bp, Artificial Sequence
  Description of Artificial Sequence: Synthetic oligonucleotide
gggactcagctgagtcccag

SEQ ID NO: 12762 - DNA, 20 bp, Artificial Sequence
  Description of Artificial Sequence: Synthetic oligonucleotide
tggactcagctgagtccagg

SEQ ID NO: 12763 - DNA, 20 bp, Artificial Sequence
  Description of Artificial Sequence: Synthetic oligonucleotide
gtgactcagctgagtcacgg

SEQ ID NO: 12764 - DNA, 20 bp, Artificial Sequence
  Description of Artificial Sequence: Synthetic oligonucleotide
gcgactcagctgagtcgccg

SEQ ID NO: 12765 - DNA, 20 bp, Artificial Sequence
  Description of Artificial Sequence: Synthetic oligonucleotide
gcgactcagctgagtcgctg

SEQ ID NO: 12766 - DNA, 20 bp, Artificial Sequence
  Description of Artificial Sequence: Synthetic oligonucleotide
acgactcagctgagtcgtcg

SEQ ID NO: 12767 - DNA, 20 bp, Artificial Sequence
  Description of Artificial Sequence: Synthetic oligonucleotide
gagactcagctgagtctccg

SEQ ID NO: 12768 - DNA, 20 bp, Artificial Sequence
  Description of Artificial Sequence: Synthetic oligonucleotide
gcgactcagctgagtcgcag

SEQ ID NO: 12769 - DNA, 20 bp, Artificial Sequence
  Description of Artificial Sequence: Synthetic oligonucleotide
gtgactcagctgagtcaccg

SEQ ID NO: 12770 - DNA, 20 bp, Artificial Sequence
  Description of Artificial Sequence: Synthetic oligonucleotide
cggactcagctgagtccgtg

SEQ ID NO: 12771 - DNA, 20 bp, Artificial Sequence
  Description of Artificial Sequence: Synthetic oligonucleotide
cagactcagctgagtctggg

SEQ ID NO: 12772 - DNA, 20 bp, Artificial Sequence
  Description of Artificial Sequence: Synthetic oligonucleotide
cggactcagctgagtccgag

SEQ ID NO: 12773 - DNA, 20 bp, Artificial Sequence
  Description of Artificial Sequence: Synthetic oligonucleotide
ctgactcagctgagtcaggg

SEQ ID NO: 12774 - DNA, 20 bp, Artificial Sequence
  Description of Artificial Sequence: Synthetic oligonucleotide
acgactcagctgagtcgtgg

SEQ ID NO: 12775 - DNA, 20 bp, Artificial Sequence
  Description of Artificial Sequence: Synthetic oligonucleotide
ccgactcagctgagtcggct

SEQ ID NO: 12776 - DNA, 20 bp, Artificial Sequence
  Description of Artificial Sequence: Synthetic oligonucleotide
ccgactcagctgagtcggca

SEQ ID NO: 12777 - DNA, 20 bp, Artificial Sequence
  Description of Artificial Sequence: Synthetic oligonucleotide
gagactcagctgagtctcgc

SEQ ID NO: 12778 - DNA, 20 bp, Artificial Sequence
  Description of Artificial Sequence: Synthetic oligonucleotide
gtgactcagctgagtcacgc

SEQ ID NO: 12779 - DNA, 20 bp, Artificial Sequence
  Description of Artificial Sequence: Synthetic oligonucleotide
aggactcagctgagtcctgc

SEQ ID NO: 12780 - DNA, 20 bp, Artificial Sequence
  Description of Artificial Sequence: Synthetic oligonucleotide
tggactcagctgagtccagc

SEQ ID NO: 12781 - DNA, 20 bp, Artificial Sequence
  Description of Artificial Sequence: Synthetic oligonucleotide
aggactcagctgagtcctcg

SEQ ID NO: 12782 - DNA, 20 bp, Artificial Sequence
  Description of Artificial Sequence: Synthetic oligonucleotide
tggactcagctgagtccacg

SEQ ID NO: 12783 - DNA, 20 bp, Artificial Sequence
  Description of Artificial Sequence: Synthetic oligonucleotide
ccgactcagctgagtcggtg

SEQ ID NO: 12784 - DNA, 20 bp, Artificial Sequence
  Description of Artificial Sequence: Synthetic oligonucleotide
ccgactcagctgagtcggag

SEQ ID NO: 12785 - DNA, 20 bp, Artificial Sequence
  Description of Artificial Sequence: Synthetic oligonucleotide
gggactcagctgagtcccgc

SEQ ID NO: 12786 - DNA, 20 bp, Artificial Sequence
  Description of Artificial Sequence: Synthetic oligonucleotide
gggactcagctgagtccctc

SEQ ID NO: 12787 - DNA, 20 bp, Artificial Sequence
  Description of Artificial Sequence: Synthetic oligonucleotide
gggactcagctgagtcccac

SEQ ID NO: 12788 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcaattgagtcnnnn

SEQ ID NO: 12789 - DNA, 20 bp, Artificial Sequence
  Description of Artificial Sequence: Synthetic oligonucleotide
cggactcaattgagtccgcc

SEQ ID NO: 12790 - DNA, 20 bp, Artificial Sequence
  Description of Artificial Sequence: Synthetic oligonucleotide
cggactcaattgagtccgct

SEQ ID NO: 12791 - DNA, 20 bp, Artificial Sequence
  Description of Artificial Sequence: Synthetic oligonucleotide
cggactcaattgagtccgtc

SEQ ID NO: 12792 - DNA, 20 bp, Artificial Sequence
  Description of Artificial Sequence: Synthetic oligonucleotide
aggactcaattgagtcctcc

SEQ ID NO: 12793 - DNA, 20 bp, Artificial Sequence
  Description of Artificial Sequence: Synthetic oligonucleotide
cagactcaattgagtctgcc

SEQ ID NO: 12794 - DNA, 20 bp, Artificial Sequence
  Description of Artificial Sequence: Synthetic oligonucleotide
cggactcaattgagtccgca

SEQ ID NO: 12795 - DNA, 20 bp, Artificial Sequence
  Description of Artificial Sequence: Synthetic oligonucleotide
cggactcaattgagtccgac

SEQ ID NO: 12796 - DNA, 20 bp, Artificial Sequence
  Description of Artificial Sequence: Synthetic oligonucleotide
tggactcaattgagtccacc

SEQ ID NO: 12797 - DNA, 20 bp, Artificial Sequence
  Description of Artificial Sequence: Synthetic oligonucleotide
ctgactcaattgagtcagcc

SEQ ID NO: 12798 - DNA, 20 bp, Artificial Sequence
  Description of Artificial Sequence: Synthetic oligonucleotide
ccgactcaattgagtcgggc

SEQ ID NO: 12799 - DNA, 20 bp, Artificial Sequence
  Description of Artificial Sequence: Synthetic oligonucleotide
ccgactcaattgagtcgggt

SEQ ID NO: 12800 - DNA, 20 bp, Artificial Sequence
  Description of Artificial Sequence: Synthetic oligonucleotide
ccgactcaattgagtcggtc

SEQ ID NO: 12801 - DNA, 20 bp, Artificial Sequence
  Description of Artificial Sequence: Synthetic oligonucleotide
acgactcaattgagtcgtgc

SEQ ID NO: 12802 - DNA, 20 bp, Artificial Sequence
  Description of Artificial Sequence: Synthetic oligonucleotide
cagactcaattgagtctggc

SEQ ID NO: 12803 - DNA, 20 bp, Artificial Sequence
  Description of Artificial Sequence: Synthetic oligonucleotide
ccgactcaattgagtcggga

SEQ ID NO: 12804 - DNA, 20 bp, Artificial Sequence
  Description of Artificial Sequence: Synthetic oligonucleotide
ccgactcaattgagtcggac

SEQ ID NO: 12805 - DNA, 20 bp, Artificial Sequence
  Description of Artificial Sequence: Synthetic oligonucleotide
ctgactcaattgagtcaggc

SEQ ID NO: 12806 - DNA, 20 bp, Artificial Sequence
  Description of Artificial Sequence: Synthetic oligonucleotide
gcgactcaattgagtcgccc

SEQ ID NO: 12807 - DNA, 20 bp, Artificial Sequence
  Description of Artificial Sequence: Synthetic oligonucleotide
gcgactcaattgagtcgcct

SEQ ID NO: 12808 - DNA, 20 bp, Artificial Sequence
  Description of Artificial Sequence: Synthetic oligonucleotide
gcgactcaattgagtcgctc

SEQ ID NO: 12809 - DNA, 20 bp, Artificial Sequence
  Description of Artificial Sequence: Synthetic oligonucleotide
acgactcaattgagtcgtcc

SEQ ID NO: 12810 - DNA, 20 bp, Artificial Sequence
  Description of Artificial Sequence: Synthetic oligonucleotide
gagactcaattgagtctccc

SEQ ID NO: 12811 - DNA, 20 bp, Artificial Sequence
  Description of Artificial Sequence: Synthetic oligonucleotide
gcgactcaattgagtcgcca

SEQ ID NO: 12812 - DNA, 20 bp, Artificial Sequence
  Description of Artificial Sequence: Synthetic oligonucleotide
gcgactcaattgagtcgcac

SEQ ID NO: 12813 - DNA, 20 bp, Artificial Sequence
  Description of Artificial Sequence: Synthetic oligonucleotide
gtgactcaattgagtcaccc

SEQ ID NO: 12814 - DNA, 20 bp, Artificial Sequence
  Description of Artificial Sequence: Synthetic oligonucleotide
gggactcaattgagtcccgt

SEQ ID NO: 12815 - DNA, 20 bp, Artificial Sequence
  Description of Artificial Sequence: Synthetic oligonucleotide
gggactcaattgagtccctg

SEQ ID NO: 12816 - DNA, 20 bp, Artificial Sequence
  Description of Artificial Sequence: Synthetic oligonucleotide
aggactcaattgagtcctgg

SEQ ID NO: 12817 - DNA, 20 bp, Artificial Sequence
  Description of Artificial Sequence: Synthetic oligonucleotide
gagactcaattgagtctcgg

SEQ ID NO: 12818 - DNA, 20 bp, Artificial Sequence
  Description of Artificial Sequence: Synthetic oligonucleotide
gggactcaattgagtcccga

SEQ ID NO: 12819 - DNA, 20 bp, Artificial Sequence
  Description of Artificial Sequence: Synthetic oligonucleotide
gggactcaattgagtcccag

SEQ ID NO: 12820 - DNA, 20 bp, Artificial Sequence
  Description of Artificial Sequence: Synthetic oligonucleotide
tggactcaattgagtccagg

SEQ ID NO: 12821 - DNA, 20 bp, Artificial Sequence
  Description of Artificial Sequence: Synthetic oligonucleotide
gtgactcaattgagtcacgg

SEQ ID NO: 12822 - DNA, 20 bp, Artificial Sequence
  Description of Artificial Sequence: Synthetic oligonucleotide
gcgactcaattgagtcgccg

SEQ ID NO: 12823 - DNA, 20 bp, Artificial Sequence
  Description of Artificial Sequence: Synthetic oligonucleotide
gcgactcaattgagtcgctg

SEQ ID NO: 12824 - DNA, 20 bp, Artificial Sequence
  Description of Artificial Sequence: Synthetic oligonucleotide
acgactcaattgagtcgtcg

SEQ ID NO: 12825 - DNA, 20 bp, Artificial Sequence
  Description of Artificial Sequence: Synthetic oligonucleotide
gagactcaattgagtctccg

SEQ ID NO: 12826 - DNA, 20 bp, Artificial Sequence
  Description of Artificial Sequence: Synthetic oligonucleotide
gcgactcaattgagtcgcag

SEQ ID NO: 12827 - DNA, 20 bp, Artificial Sequence
  Description of Artificial Sequence: Synthetic oligonucleotide
gtgactcaattgagtcaccg

SEQ ID NO: 12828 - DNA, 20 bp, Artificial Sequence
  Description of Artificial Sequence: Synthetic oligonucleotide
cggactcaattgagtccgtg

SEQ ID NO: 12829 - DNA, 20 bp, Artificial Sequence
  Description of Artificial Sequence: Synthetic oligonucleotide
cagactcaattgagtctggg

SEQ ID NO: 12830 - DNA, 20 bp, Artificial Sequence
  Description of Artificial Sequence: Synthetic oligonucleotide
cggactcaattgagtccgag

SEQ ID NO: 12831 - DNA, 20 bp, Artificial Sequence
  Description of Artificial Sequence: Synthetic oligonucleotide
ctgactcaattgagtcaggg

SEQ ID NO: 12832 - DNA, 20 bp, Artificial Sequence
  Description of Artificial Sequence: Synthetic oligonucleotide
acgactcaattgagtcgtgg

SEQ ID NO: 12833 - DNA, 20 bp, Artificial Sequence
  Description of Artificial Sequence: Synthetic oligonucleotide
ccgactcaattgagtcggct

SEQ ID NO: 12834 - DNA, 20 bp, Artificial Sequence
  Description of Artificial Sequence: Synthetic oligonucleotide
ccgactcaattgagtcggca

SEQ ID NO: 12835 - DNA, 20 bp, Artificial Sequence
  Description of Artificial Sequence: Synthetic oligonucleotide
gagactcaattgagtctcgc

SEQ ID NO: 12836 - DNA, 20 bp, Artificial Sequence
  Description of Artificial Sequence: Synthetic oligonucleotide
gtgactcaattgagtcacgc

SEQ ID NO: 12837 - DNA, 20 bp, Artificial Sequence
  Description of Artificial Sequence: Synthetic oligonucleotide
aggactcaattgagtcctgc

SEQ ID NO: 12838 - DNA, 20 bp, Artificial Sequence
  Description of Artificial Sequence: Synthetic oligonucleotide
tggactcaattgagtccagc

SEQ ID NO: 12839 - DNA, 20 bp, Artificial Sequence
  Description of Artificial Sequence: Synthetic oligonucleotide
aggactcaattgagtcctcg

SEQ ID NO: 12840 - DNA, 20 bp, Artificial Sequence
  Description of Artificial Sequence: Synthetic oligonucleotide
tggactcaattgagtccacg

SEQ ID NO: 12841 - DNA, 20 bp, Artificial Sequence
  Description of Artificial Sequence: Synthetic oligonucleotide
ccgactcaattgagtcggtg

SEQ ID NO: 12842 - DNA, 20 bp, Artificial Sequence
  Description of Artificial Sequence: Synthetic oligonucleotide
ccgactcaattgagtcggag

SEQ ID NO: 12843 - DNA, 20 bp, Artificial Sequence
  Description of Artificial Sequence: Synthetic oligonucleotide
gggactcaattgagtcccgc

SEQ ID NO: 12844 - DNA, 20 bp, Artificial Sequence
  Description of Artificial Sequence: Synthetic oligonucleotide
gggactcaattgagtccctc

SEQ ID NO: 12845 - DNA, 20 bp, Artificial Sequence
  Description of Artificial Sequence: Synthetic oligonucleotide
gggactcaattgagtcccac

SEQ ID NO: 12846 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactctatagagtcnnnn

SEQ ID NO: 12847 - DNA, 20 bp, Artificial Sequence
  Description of Artificial Sequence: Synthetic oligonucleotide
cggactctatagagtccgcc

SEQ ID NO: 12848 - DNA, 20 bp, Artificial Sequence
  Description of Artificial Sequence: Synthetic oligonucleotide
cggactctatagagtccgct

SEQ ID NO: 12849 - DNA, 20 bp, Artificial Sequence
  Description of Artificial Sequence: Synthetic oligonucleotide
cggactctatagagtccgtc

SEQ ID NO: 12850 - DNA, 20 bp, Artificial Sequence
  Description of Artificial Sequence: Synthetic oligonucleotide
aggactctatagagtcctcc

SEQ ID NO: 12851 - DNA, 20 bp, Artificial Sequence
  Description of Artificial Sequence: Synthetic oligonucleotide
cagactctatagagtctgcc

SEQ ID NO: 12852 - DNA, 20 bp, Artificial Sequence
  Description of Artificial Sequence: Synthetic oligonucleotide
cggactctatagagtccgca

SEQ ID NO: 12853 - DNA, 20 bp, Artificial Sequence
  Description of Artificial Sequence: Synthetic oligonucleotide
cggactctatagagtccgac

SEQ ID NO: 12854 - DNA, 20 bp, Artificial Sequence
  Description of Artificial Sequence: Synthetic oligonucleotide
tggactctatagagtccacc

SEQ ID NO: 12855 - DNA, 20 bp, Artificial Sequence
  Description of Artificial Sequence: Synthetic oligonucleotide
ctgactctatagagtcagcc

SEQ ID NO: 12856 - DNA, 20 bp, Artificial Sequence
  Description of Artificial Sequence: Synthetic oligonucleotide
ccgactctatagagtcgggc

SEQ ID NO: 12857 - DNA, 20 bp, Artificial Sequence
  Description of Artificial Sequence: Synthetic oligonucleotide
ccgactctatagagtcgggt

SEQ ID NO: 12858 - DNA, 20 bp, Artificial Sequence
  Description of Artificial Sequence: Synthetic oligonucleotide
ccgactctatagagtcggtc

SEQ ID NO: 12859 - DNA, 20 bp, Artificial Sequence
  Description of Artificial Sequence: Synthetic oligonucleotide
acgactctatagagtcgtgc

SEQ ID NO: 12860 - DNA, 20 bp, Artificial Sequence
  Description of Artificial Sequence: Synthetic oligonucleotide
cagactctatagagtctggc

SEQ ID NO: 12861 - DNA, 20 bp, Artificial Sequence
  Description of Artificial Sequence: Synthetic oligonucleotide
ccgactctatagagtcggga

SEQ ID NO: 12862 - DNA, 20 bp, Artificial Sequence
  Description of Artificial Sequence: Synthetic oligonucleotide
ccgactctatagagtcggac

SEQ ID NO: 12863 - DNA, 20 bp, Artificial Sequence
  Description of Artificial Sequence: Synthetic oligonucleotide
ctgactctatagagtcaggc

SEQ ID NO: 12864 - DNA, 20 bp, Artificial Sequence
  Description of Artificial Sequence: Synthetic oligonucleotide
gcgactctatagagtcgccc

SEQ ID NO: 12865 - DNA, 20 bp, Artificial Sequence
  Description of Artificial Sequence: Synthetic oligonucleotide
gcgactctatagagtcgcct

SEQ ID NO: 12866 - DNA, 20 bp, Artificial Sequence
  Description of Artificial Sequence: Synthetic oligonucleotide
gcgactctatagagtcgctc

SEQ ID NO: 12867 - DNA, 20 bp, Artificial Sequence
  Description of Artificial Sequence: Synthetic oligonucleotide
acgactctatagagtcgtcc

SEQ ID NO: 12868 - DNA, 20 bp, Artificial Sequence
  Description of Artificial Sequence: Synthetic oligonucleotide
gagactctatagagtctccc

SEQ ID NO: 12869 - DNA, 20 bp, Artificial Sequence
  Description of Artificial Sequence: Synthetic oligonucleotide
gcgactctatagagtcgcca

SEQ ID NO: 12870 - DNA, 20 bp, Artificial Sequence
  Description of Artificial Sequence: Synthetic oligonucleotide
gcgactctatagagtcgcac

SEQ ID NO: 12871 - DNA, 20 bp, Artificial Sequence
  Description of Artificial Sequence: Synthetic oligonucleotide
gtgactctatagagtcaccc

SEQ ID NO: 12872 - DNA, 20 bp, Artificial Sequence
  Description of Artificial Sequence: Synthetic oligonucleotide
gggactctatagagtcccgt

SEQ ID NO: 12873 - DNA, 20 bp, Artificial Sequence
  Description of Artificial Sequence: Synthetic oligonucleotide
gggactctatagagtccctg

SEQ ID NO: 12874 - DNA, 20 bp, Artificial Sequence
  Description of Artificial Sequence: Synthetic oligonucleotide
aggactctatagagtcctgg

SEQ ID NO: 12875 - DNA, 20 bp, Artificial Sequence
  Description of Artificial Sequence: Synthetic oligonucleotide
gagactctatagagtctcgg

SEQ ID NO: 12876 - DNA, 20 bp, Artificial Sequence
  Description of Artificial Sequence: Synthetic oligonucleotide
gggactctatagagtcccga

SEQ ID NO: 12877 - DNA, 20 bp, Artificial Sequence
  Description of Artificial Sequence: Synthetic oligonucleotide
gggactctatagagtcccag

SEQ ID NO: 12878 - DNA, 20 bp, Artificial Sequence
  Description of Artificial Sequence: Synthetic oligonucleotide
tggactctatagagtccagg

SEQ ID NO: 12879 - DNA, 20 bp, Artificial Sequence
  Description of Artificial Sequence: Synthetic oligonucleotide
gtgactctatagagtcacgg

SEQ ID NO: 12880 - DNA, 20 bp, Artificial Sequence
  Description of Artificial Sequence: Synthetic oligonucleotide
gcgactctatagagtcgccg

SEQ ID NO: 12881 - DNA, 20 bp, Artificial Sequence
  Description of Artificial Sequence: Synthetic oligonucleotide
gcgactctatagagtcgctg

SEQ ID NO: 12882 - DNA, 20 bp, Artificial Sequence
  Description of Artificial Sequence: Synthetic oligonucleotide
acgactctatagagtcgtcg

SEQ ID NO: 12883 - DNA, 20 bp, Artificial Sequence
  Description of Artificial Sequence: Synthetic oligonucleotide
gagactctatagagtctccg

SEQ ID NO: 12884 - DNA, 20 bp, Artificial Sequence
  Description of Artificial Sequence: Synthetic oligonucleotide
gcgactctatagagtcgcag

SEQ ID NO: 12885 - DNA, 20 bp, Artificial Sequence
  Description of Artificial Sequence: Synthetic oligonucleotide
gtgactctatagagtcaccg

SEQ ID NO: 12886 - DNA, 20 bp, Artificial Sequence
  Description of Artificial Sequence: Synthetic oligonucleotide
cggactctatagagtccgtg

SEQ ID NO: 12887 - DNA, 20 bp, Artificial Sequence
  Description of Artificial Sequence: Synthetic oligonucleotide
cagactctatagagtctggg

SEQ ID NO: 12888 - DNA, 20 bp, Artificial Sequence
  Description of Artificial Sequence: Synthetic oligonucleotide
cggactctatagagtccgag

SEQ ID NO: 12889 - DNA, 20 bp, Artificial Sequence
  Description of Artificial Sequence: Synthetic oligonucleotide
ctgactctatagagtcaggg

SEQ ID NO: 12890 - DNA, 20 bp, Artificial Sequence
  Description of Artificial Sequence: Synthetic oligonucleotide
acgactctatagagtcgtgg

SEQ ID NO: 12891 - DNA, 20 bp, Artificial Sequence
  Description of Artificial Sequence: Synthetic oligonucleotide
ccgactctatagagtcggct

SEQ ID NO: 12892 - DNA, 20 bp, Artificial Sequence
  Description of Artificial Sequence: Synthetic oligonucleotide
ccgactctatagagtcggca

SEQ ID NO: 12893 - DNA, 20 bp, Artificial Sequence
  Description of Artificial Sequence: Synthetic oligonucleotide
gagactctatagagtctcgc

SEQ ID NO: 12894 - DNA, 20 bp, Artificial Sequence
  Description of Artificial Sequence: Synthetic oligonucleotide
gtgactctatagagtcacgc

SEQ ID NO: 12895 - DNA, 20 bp, Artificial Sequence
  Description of Artificial Sequence: Synthetic oligonucleotide
aggactctatagagtcctgc

SEQ ID NO: 12896 - DNA, 20 bp, Artificial Sequence
  Description of Artificial Sequence: Synthetic oligonucleotide
tggactctatagagtccagc

SEQ ID NO: 12897 - DNA, 20 bp, Artificial Sequence
  Description of Artificial Sequence: Synthetic oligonucleotide
aggactctatagagtcctcg

SEQ ID NO: 12898 - DNA, 20 bp, Artificial Sequence
  Description of Artificial Sequence: Synthetic oligonucleotide
tggactctatagagtccacg

SEQ ID NO: 12899 - DNA, 20 bp, Artificial Sequence
  Description of Artificial Sequence: Synthetic oligonucleotide
ccgactctatagagtcggtg

SEQ ID NO: 12900 - DNA, 20 bp, Artificial Sequence
  Description of Artificial Sequence: Synthetic oligonucleotide
ccgactctatagagtcggag

SEQ ID NO: 12901 - DNA, 20 bp, Artificial Sequence
  Description of Artificial Sequence: Synthetic oligonucleotide
gggactctatagagtcccgc

SEQ ID NO: 12902 - DNA, 20 bp, Artificial Sequence
  Description of Artificial Sequence: Synthetic oligonucleotide
gggactctatagagtccctc

SEQ ID NO: 12903 - DNA, 20 bp, Artificial Sequence
  Description of Artificial Sequence: Synthetic oligonucleotide
gggactctatagagtcccac

SEQ ID NO: 12904 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcatatgagtcnnnn

SEQ ID NO: 12905 - DNA, 20 bp, Artificial Sequence
  Description of Artificial Sequence: Synthetic oligonucleotide
cggactcatatgagtccgcc

SEQ ID NO: 12906 - DNA, 20 bp, Artificial Sequence
  Description of Artificial Sequence: Synthetic oligonucleotide
cggactcatatgagtccgct

SEQ ID NO: 12907 - DNA, 20 bp, Artificial Sequence
  Description of Artificial Sequence: Synthetic oligonucleotide
cggactcatatgagtccgtc

SEQ ID NO: 12908 - DNA, 20 bp, Artificial Sequence
  Description of Artificial Sequence: Synthetic oligonucleotide
aggactcatatgagtcctcc

SEQ ID NO: 12909 - DNA, 20 bp, Artificial Sequence
  Description of Artificial Sequence: Synthetic oligonucleotide
cagactcatatgagtctgcc

SEQ ID NO: 12910 - DNA, 20 bp, Artificial Sequence
  Description of Artificial Sequence: Synthetic oligonucleotide
cggactcatatgagtccgca

SEQ ID NO: 12911 - DNA, 20 bp, Artificial Sequence
  Description of Artificial Sequence: Synthetic oligonucleotide
cggactcatatgagtccgac

SEQ ID NO: 12912 - DNA, 20 bp, Artificial Sequence
  Description of Artificial Sequence: Synthetic oligonucleotide
tggactcatatgagtccacc

SEQ ID NO: 12913 - DNA, 20 bp, Artificial Sequence
  Description of Artificial Sequence: Synthetic oligonucleotide
ctgactcatatgagtcagcc

SEQ ID NO: 12914 - DNA, 20 bp, Artificial Sequence
  Description of Artificial Sequence: Synthetic oligonucleotide
ccgactcatatgagtcgggc

SEQ ID NO: 12915 - DNA, 20 bp, Artificial Sequence
  Description of Artificial Sequence: Synthetic oligonucleotide
ccgactcatatgagtcgggt

SEQ ID NO: 12916 - DNA, 20 bp, Artificial Sequence
  Description of Artificial Sequence: Synthetic oligonucleotide
ccgactcatatgagtcggtc

SEQ ID NO: 12917 - DNA, 20 bp, Artificial Sequence
  Description of Artificial Sequence: Synthetic oligonucleotide
acgactcatatgagtcgtgc

SEQ ID NO: 12918 - DNA, 20 bp, Artificial Sequence
  Description of Artificial Sequence: Synthetic oligonucleotide
cagactcatatgagtctggc

SEQ ID NO: 12919 - DNA, 20 bp, Artificial Sequence
  Description of Artificial Sequence: Synthetic oligonucleotide
ccgactcatatgagtcggga

SEQ ID NO: 12920 - DNA, 20 bp, Artificial Sequence
  Description of Artificial Sequence: Synthetic oligonucleotide
ccgactcatatgagtcggac

SEQ ID NO: 12921 - DNA, 20 bp, Artificial Sequence
  Description of Artificial Sequence: Synthetic oligonucleotide
ctgactcatatgagtcaggc

SEQ ID NO: 12922 - DNA, 20 bp, Artificial Sequence
  Description of Artificial Sequence: Synthetic oligonucleotide
gcgactcatatgagtcgccc

SEQ ID NO: 12923 - DNA, 20 bp, Artificial Sequence
  Description of Artificial Sequence: Synthetic oligonucleotide
gcgactcatatgagtcgcct

SEQ ID NO: 12924 - DNA, 20 bp, Artificial Sequence
  Description of Artificial Sequence: Synthetic oligonucleotide
gcgactcatatgagtcgctc

SEQ ID NO: 12925 - DNA, 20 bp, Artificial Sequence
  Description of Artificial Sequence: Synthetic oligonucleotide
acgactcatatgagtcgtcc

SEQ ID NO: 12926 - DNA, 20 bp, Artificial Sequence
  Description of Artificial Sequence: Synthetic oligonucleotide
gagactcatatgagtctccc

SEQ ID NO: 12927 - DNA, 20 bp, Artificial Sequence
  Description of Artificial Sequence: Synthetic oligonucleotide
gcgactcatatgagtcgcca

SEQ ID NO: 12928 - DNA, 20 bp, Artificial Sequence
  Description of Artificial Sequence: Synthetic oligonucleotide
gcgactcatatgagtcgcac

SEQ ID NO: 12929 - DNA, 20 bp, Artificial Sequence
  Description of Artificial Sequence: Synthetic oligonucleotide
gtgactcatatgagtcaccc

SEQ ID NO: 12930 - DNA, 20 bp, Artificial Sequence
  Description of Artificial Sequence: Synthetic oligonucleotide
gggactcatatgagtcccgt

SEQ ID NO: 12931 - DNA, 20 bp, Artificial Sequence
  Description of Artificial Sequence: Synthetic oligonucleotide
gggactcatatgagtccctg

SEQ ID NO: 12932 - DNA, 20 bp, Artificial Sequence
  Description of Artificial Sequence: Synthetic oligonucleotide
aggactcatatgagtcctgg

SEQ ID NO: 12933 - DNA, 20 bp, Artificial Sequence
  Description of Artificial Sequence: Synthetic oligonucleotide
gagactcatatgagtctcgg

SEQ ID NO: 12934 - DNA, 20 bp, Artificial Sequence
  Description of Artificial Sequence: Synthetic oligonucleotide
gggactcatatgagtcccga

SEQ ID NO: 12935 - DNA, 20 bp, Artificial Sequence
  Description of Artificial Sequence: Synthetic oligonucleotide
gggactcatatgagtcccag

SEQ ID NO: 12936 - DNA, 20 bp, Artificial Sequence
  Description of Artificial Sequence: Synthetic oligonucleotide
tggactcatatgagtccagg

SEQ ID NO: 12937 - DNA, 20 bp, Artificial Sequence
  Description of Artificial Sequence: Synthetic oligonucleotide
gtgactcatatgagtcacgg

SEQ ID NO: 12938 - DNA, 20 bp, Artificial Sequence
  Description of Artificial Sequence: Synthetic oligonucleotide
gcgactcatatgagtcgccg

SEQ ID NO: 12939 - DNA, 20 bp, Artificial Sequence
  Description of Artificial Sequence: Synthetic oligonucleotide
gcgactcatatgagtcgctg

SEQ ID NO: 12940 - DNA, 20 bp, Artificial Sequence
  Description of Artificial Sequence: Synthetic oligonucleotide
acgactcatatgagtcgtcg

SEQ ID NO: 12941 - DNA, 20 bp, Artificial Sequence
  Description of Artificial Sequence: Synthetic oligonucleotide
gagactcatatgagtctccg

SEQ ID NO: 12942 - DNA, 20 bp, Artificial Sequence
  Description of Artificial Sequence: Synthetic oligonucleotide
gcgactcatatgagtcgcag

SEQ ID NO: 12943 - DNA, 20 bp, Artificial Sequence
  Description of Artificial Sequence: Synthetic oligonucleotide
gtgactcatatgagtcaccg

SEQ ID NO: 12944 - DNA, 20 bp, Artificial Sequence
  Description of Artificial Sequence: Synthetic oligonucleotide
cggactcatatgagtccgtg

SEQ ID NO: 12945 - DNA, 20 bp, Artificial Sequence
  Description of Artificial Sequence: Synthetic oligonucleotide
cagactcatatgagtctggg

SEQ ID NO: 12946 - DNA, 20 bp, Artificial Sequence
  Description of Artificial Sequence: Synthetic oligonucleotide
cggactcatatgagtccgag

SEQ ID NO: 12947 - DNA, 20 bp, Artificial Sequence
  Description of Artificial Sequence: Synthetic oligonucleotide
ctgactcatatgagtcaggg

SEQ ID NO: 12948 - DNA, 20 bp, Artificial Sequence
  Description of Artificial Sequence: Synthetic oligonucleotide
acgactcatatgagtcgtgg

SEQ ID NO: 12949 - DNA, 20 bp, Artificial Sequence
  Description of Artificial Sequence: Synthetic oligonucleotide
ccgactcatatgagtcggct

SEQ ID NO: 12950 - DNA, 20 bp, Artificial Sequence
  Description of Artificial Sequence: Synthetic oligonucleotide
ccgactcatatgagtcggca

SEQ ID NO: 12951 - DNA, 20 bp, Artificial Sequence
  Description of Artificial Sequence: Synthetic oligonucleotide
gagactcatatgagtctcgc

SEQ ID NO: 12952 - DNA, 20 bp, Artificial Sequence
  Description of Artificial Sequence: Synthetic oligonucleotide
gtgactcatatgagtcacgc

SEQ ID NO: 12953 - DNA, 20 bp, Artificial Sequence
  Description of Artificial Sequence: Synthetic oligonucleotide
aggactcatatgagtcctgc

SEQ ID NO: 12954 - DNA, 20 bp, Artificial Sequence
  Description of Artificial Sequence: Synthetic oligonucleotide
tggactcatatgagtccagc

SEQ ID NO: 12955 - DNA, 20 bp, Artificial Sequence
  Description of Artificial Sequence: Synthetic oligonucleotide
aggactcatatgagtcctcg

SEQ ID NO: 12956 - DNA, 20 bp, Artificial Sequence
  Description of Artificial Sequence: Synthetic oligonucleotide
tggactcatatgagtccacg

SEQ ID NO: 12957 - DNA, 20 bp, Artificial Sequence
  Description of Artificial Sequence: Synthetic oligonucleotide
ccgactcatatgagtcggtg

SEQ ID NO: 12958 - DNA, 20 bp, Artificial Sequence
  Description of Artificial Sequence: Synthetic oligonucleotide
ccgactcatatgagtcggag

SEQ ID NO: 12959 - DNA, 20 bp, Artificial Sequence
  Description of Artificial Sequence: Synthetic oligonucleotide
gggactcatatgagtcccgc

SEQ ID NO: 12960 - DNA, 20 bp, Artificial Sequence
  Description of Artificial Sequence: Synthetic oligonucleotide
gggactcatatgagtccctc

SEQ ID NO: 12961 - DNA, 20 bp, Artificial Sequence
  Description of Artificial Sequence: Synthetic oligonucleotide
gggactcatatgagtcccac

SEQ ID NO: 12962 - DNA, 20 bp, Artificial Sequence
  Description of Artificial Sequence: Synthetic oligonucleotide
  modified_base (1)..(2): a, c, t, or g
  modified_base (17)..(20): a, c, t, or g
nngactcttaagagtcnnnn

SEQ ID NO: 12963 - DNA, 20 bp, Artificial Sequence
  Description of Artificial Sequence: Synthetic oligonucleotide
cggactcttaagagtccgcc

SEQ ID NO: 12964 - DNA, 20 bp, Artificial Sequence
  Description of Artificial Sequence: Synthetic oligonucleotide
cggactcttaagagtccgct

SEQ ID NO: 12965 - DNA, 20 bp, Artificial Sequence
  Description of Artificial Sequence: Synthetic oligonucleotide
cggactcttaagagtccgtc

SEQ ID NO: 12966 - DNA, 20 bp, Artificial Sequence
  Description of Artificial Sequence: Synthetic oligonucleotide
aggactcttaagagtcctcc

SEQ ID NO: 12967 - DNA, 20 bp, Artificial Sequence
  Description of Artificial Sequence: Synthetic oligonucleotide
cagactcttaagagtctgcc

SEQ ID NO: 12968 - DNA, 20 bp, Artificial Sequence
  Description of Artificial Sequence: Synthetic oligonucleotide
cggactcttaagagtccgca

SEQ ID NO: 12969 - DNA, 20 bp, Artificial Sequence
  Description of Artificial Sequence: Synthetic oligonucleotide
cggactcttaagagtccgac

SEQ ID NO: 12970 - DNA, 20 bp, Artificial Sequence
  Description of Artificial Sequence: Synthetic oligonucleotide
tggactcttaagagtccacc

SEQ ID NO: 12971 - DNA, 20 bp, Artificial Sequence
  Description of Artificial Sequence: Synthetic oligonucleotide
ctgactcttaagagtcagcc

SEQ ID NO: 12972 - DNA, 20 bp, Artificial Sequence
  Description of Artificial Sequence: Synthetic oligonucleotide
ccgactcttaagagtcgggc

SEQ ID NO: 12973 - DNA, 20 bp, Artificial Sequence
  Description of Artificial Sequence: Synthetic oligonucleotide
ccgactcttaagagtcgggt

SEQ ID NO: 12974 - DNA, 20 bp, Artificial Sequence
  Description of Artificial Sequence: Synthetic oligonucleotide
ccgactcttaagagtcggtc

SEQ ID NO: 12975 - DNA, 20 bp, Artificial Sequence
  Description of Artificial Sequence: Synthetic oligonucleotide
acgactcttaagagtcgtgc

SEQ ID NO: 12976 - DNA, 20 bp, Artificial Sequence
  Description of Artificial Sequence: Synthetic oligonucleotide
cagactcttaagagtctggc

SEQ ID NO: 12977 - DNA, 20 bp, Artificial Sequence
  Description of Artificial Sequence: Synthetic oligonucleotide
ccgactcttaagagtcggga

SEQ ID NO: 12978 - DNA, 20 bp, Artificial Sequence
  Description of Artificial Sequence: Synthetic oligonucleotide
ccgactcttaagagtcggac

SEQ ID NO: 12979 - DNA, 20 bp, Artificial Sequence
  Description of Artificial Sequence: Synthetic oligonucleotide
ctgactcttaagagtcaggc

SEQ ID NO: 12980 - DNA, 20 bp, Artificial Sequence
  Description of Artificial Sequence: Synthetic oligonucleotide
gcgactcttaagagtcgccc

SEQ ID NO: 12981 - DNA, 20 bp, Artificial Sequence
  Description of Artificial Sequence: Synthetic oligonucleotide
gcgactcttaagagtcgcct

SEQ ID NO: 12982 - DNA, 20 bp, Artificial Sequence
  Description of Artificial Sequence: Synthetic oligonucleotide
gcgactcttaagagtcgctc

SEQ ID NO: 12983 - DNA, 20 bp, Artificial Sequence
  Description of Artificial Sequence: Synthetic oligonucleotide
acgactcttaagagtcgtcc

SEQ ID NO: 12984 - DNA, 20 bp, Artificial Sequence
  Description of Artificial Sequence: Synthetic oligonucleotide
gagactcttaagagtctccc

SEQ ID NO: 12985 - DNA, 20 bp, Artificial Sequence
  Description of Artificial Sequence: Synthetic oligonucleotide
gcgactcttaagagtcgcca

SEQ ID NO: 12986 - DNA, 20 bp, Artificial Sequence
  Description of Artificial Sequence: Synthetic oligonucleotide
gcgactcttaagagtcgcac

SEQ ID NO: 12987 - DNA, 20 bp, Artificial Sequence
  Description of Artificial Sequence: Synthetic oligonucleotide
gtgactcttaagagtcaccc

SEQ ID NO: 12988 - DNA, 20 bp, Artificial Sequence
  Description of Artificial Sequence: Synthetic oligonucleotide
gggactcttaagagtcccgt

SEQ ID NO: 12989 - DNA, 20 bp, Artificial Sequence
  Description of Artificial Sequence: Synthetic oligonucleotide
gggactcttaagagtccctg

SEQ ID NO: 12990 - DNA, 20 bp, Artificial Sequence
  Description of Artificial Sequence: Synthetic oligonucleotide
aggactcttaagagtcctgg

SEQ ID NO: 12991 - DNA, 20 bp, Artificial Sequence
  Description of Artificial Sequence: Synthetic oligonucleotide
gagactcttaagagtctcgg

SEQ ID NO: 12992 - DNA, 20 bp, Artificial Sequence
  Description of Artificial Sequence: Synthetic oligonucleotide
gggactcttaagagtcccga

SEQ ID NO: 12993 - DNA, 20 bp, Artificial Sequence
  Description of Artificial Sequence: Synthetic oligonucleotide
gggactcttaagagtcccag

SEQ ID NO: 12994 - DNA, 20 bp, Artificial Sequence
  Description of Artificial Sequence: Synthetic oligonucleotide
tggactcttaagagtccagg

SEQ ID NO: 12995 - DNA, 20 bp, Artificial Sequence
  Description of Artificial Sequence: Synthetic oligonucleotide
gtgactcttaagagtcacgg

SEQ ID NO: 12996 - DNA, 20 bp, Artificial Sequence
  Description of Artificial Sequence: Synthetic oligonucleotide
gcgactcttaagagtcgccg

SEQ ID NO: 12997 - DNA, 20 bp, Artificial Sequence
  Description of Artificial Sequence: Synthetic oligonucleotide
gcgactcttaagagtcgctg

SEQ ID NO: 12998 - DNA, 20 bp, Artificial Sequence
  Description of Artificial Sequence: Synthetic oligonucleotide
acgactcttaagagtcgtcg

SEQ ID NO: 12999 - DNA, 20 bp, Artificial Sequence
  Description of Artificial Sequence: Synthetic oligonucleotide
gagactcttaagagtctccg

SEQ ID NO: 13000 - DNA, 20 bp, Artificial Sequence
  Description of Artificial Sequence: Synthetic oligonucleotide
gcgactcttaagagtcgcag

SEQ ID NO: 13001 - DNA, 20 bp, Artificial Sequence
  Description of Artificial Sequence: Synthetic oligonucleotide
gtgactcttaagagtcaccg

SEQ ID NO: 13002 - DNA, 20 bp, Artificial Sequence
  Description of Artificial Sequence: Synthetic oligonucleotide
cggactcttaagagtccgtg

SEQ ID NO: 13003 - DNA, 20 bp, Artificial Sequence
  Description of Artificial Sequence: Synthetic oligonucleotide
cagactcttaagagtctggg

SEQ ID NO: 13004 - DNA, 20 bp, Artificial Sequence
  Description of Artificial Sequence: Synthetic oligonucleotide
cggactcttaagagtccgag

SEQ ID NO: 13005 - DNA, 20 bp, Artificial Sequence
  Description of Artificial Sequence: Synthetic oligonucleotide
ctgactcttaagagtcaggg

SEQ ID NO: 13006 - DNA, 20 bp, Artificial Sequence
  Description of Artificial Sequence: Synthetic oligonucleotide
acgactcttaagagtcgtgg

SEQ ID NO: 13007 - DNA, 20 bp, Artificial Sequence
  Description of Artificial Sequence: Synthetic oligonucleotide
ccgactcttaagagtcggct

SEQ ID NO: 13008 - DNA, 20 bp, Artificial Sequence
  Description of Artificial Sequence: Synthetic oligonucleotide
ccgactcttaagagtcggca

SEQ ID NO: 13009 - DNA, 20 bp, Artificial Sequence
  Description of Artificial Sequence: Synthetic oligonucleotide
gagactcttaagagtctcgc

SEQ ID NO: 13010 - DNA, 20 bp, Artificial Sequence
  Description of Artificial Sequence: Synthetic oligonucleotide
gtgactcttaagagtcacgc

SEQ ID NO: 13011 - DNA, 20 bp, Artificial Sequence
  Description of Artificial Sequence: Synthetic oligonucleotide
aggactcttaagagtcctgc

SEQ ID NO: 13012 - DNA, 20 bp, Artificial Sequence
  Description of Artificial Sequence: Synthetic oligonucleotide
tggactcttaagagtccagc

SEQ ID NO: 13013 - DNA, 20 bp, Artificial Sequence
  Description of Artificial Sequence: Synthetic oligonucleotide
aggactcttaagagtcctcg

SEQ ID NO: 13014 - DNA, 20 bp, Artificial Sequence
  Description of Artificial Sequence: Synthetic oligonucleotide
tggactcttaagagtccacg

SEQ ID NO: 13015 - DNA, 20 bp, Artificial Sequence
  Description of Artificial Sequence: Synthetic oligonucleotide
ccgactcttaagagtcggtg

SEQ ID NO: 13016 - DNA, 20 bp, Artificial Sequence
  Description of Artificial Sequence: Synthetic oligonucleotide
ccgactcttaagagtcggag

SEQ ID NO: 13017 - DNA, 20 bp, Artificial Sequence
  Description of Artificial Sequence: Synthetic oligonucleotide
gggactcttaagagtcccgc

SEQ ID NO: 13018 - DNA, 20 bp, Artificial Sequence
  Description of Artificial Sequence: Synthetic oligonucleotide
gggactcttaagagtccctc

SEQ ID NO: 13019 - DNA, 20 bp, Artificial Sequence
  Description of Artificial Sequence: Synthetic oligonucleotide
gggactcttaagagtcccac

SEQ ID NO: 13020 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactccgcggagtcnnnn

SEQ ID NO: 13021 - DNA, 19 bp, Artificial Sequence
  Description of Artificial Sequence: Synthetic oligonucleotide
ggactccgcggagtccgcc

SEQ ID NO: 13022 - DNA, 19 bp, Artificial Sequence
  Description of Artificial Sequence: Synthetic oligonucleotide
ggactccgcggagtccgct

SEQ ID NO: 13023 - DNA, 19 bp, Artificial Sequence
  Description of Artificial Sequence: Synthetic oligonucleotide
ggactccgcggagtccgtc

SEQ ID NO: 13024 - DNA, 19 bp, Artificial Sequence
  Description of Artificial Sequence: Synthetic oligonucleotide
ggactccgcggagtcctcc

SEQ ID NO: 13025 - DNA, 19 bp, Artificial Sequence
  Description of Artificial Sequence: Synthetic oligonucleotide
agactccgcggagtctgcc

SEQ ID NO: 13026 - DNA, 19 bp, Artificial Sequence
  Description of Artificial Sequence: Synthetic oligonucleotide
ggactccgcggagtccgca

SEQ ID NO: 13027 - DNA, 19 bp, Artificial Sequence
  Description of Artificial Sequence: Synthetic oligonucleotide
ggactccgcggagtccgac

SEQ ID NO: 13028 - DNA, 19 bp, Artificial Sequence
  Description of Artificial Sequence: Synthetic oligonucleotide
ggactccgcggagtccacc

SEQ ID NO: 13029 - DNA, 19 bp, Artificial Sequence
  Description of Artificial Sequence: Synthetic oligonucleotide
tgactccgcggagtcagcc

SEQ ID NO: 13030 - DNA, 19 bp, Artificial Sequence
  Description of Artificial Sequence: Synthetic oligonucleotide
cgactccgcggagtcgggc

SEQ ID NO: 13031 - DNA, 19 bp, Artificial Sequence
  Description of Artificial Sequence: Synthetic oligonucleotide
cgactccgcggagtcgggt

SEQ ID NO: 13032 - DNA, 19 bp, Artificial Sequence
  Description of Artificial Sequence: Synthetic oligonucleotide
cgactccgcggagtcggtc

SEQ ID NO: 13033 - DNA, 19 bp, Artificial Sequence
  Description of Artificial Sequence: Synthetic oligonucleotide
cgactccgcggagtcgtgc

SEQ ID NO: 13034 - DNA, 19 bp, Artificial Sequence
  Description of Artificial Sequence: Synthetic oligonucleotide
agactccgcggagtctggc

SEQ ID NO: 13035 - DNA, 19 bp, Artificial Sequence
  Description of Artificial Sequence: Synthetic oligonucleotide
cgactccgcggagtcggga

SEQ ID NO: 13036 - DNA, 19 bp, Artificial Sequence
  Description of Artificial Sequence: Synthetic oligonucleotide
cgactccgcggagtcggac

SEQ ID NO: 13037 - DNA, 19 bp, Artificial Sequence
  Description of Artificial Sequence: Synthetic oligonucleotide
tgactccgcggagtcaggc

SEQ ID NO: 13038 - DNA, 19 bp, Artificial Sequence
  Description of Artificial Sequence: Synthetic oligonucleotide
cgactccgcggagtcgccc

SEQ ID NO: 13039 - DNA, 19 bp, Artificial Sequence
  Description of Artificial Sequence: Synthetic oligonucleotide
cgactccgcggagtcgcct

SEQ ID NO: 13040 - DNA, 19 bp, Artificial Sequence
  Description of Artificial Sequence: Synthetic oligonucleotide
cgactccgcggagtcgctc

SEQ ID NO: 13041 - DNA, 19 bp, Artificial Sequence
  Description of Artificial Sequence: Synthetic oligonucleotide
cgactccgcggagtcgtcc

SEQ ID NO: 13042 - DNA, 19 bp, Artificial Sequence
  Description of Artificial Sequence: Synthetic oligonucleotide
agactccgcggagtctccc

SEQ ID NO: 13043 - DNA, 19 bp, Artificial Sequence
  Description of Artificial Sequence: Synthetic oligonucleotide
cgactccgcggagtcgcca

SEQ ID NO: 13044 - DNA, 19 bp, Artificial Sequence
  Description of Artificial Sequence: Synthetic oligonucleotide
cgactccgcggagtcgcac

SEQ ID NO: 13045 - DNA, 19 bp, Artificial Sequence
  Description of Artificial Sequence: Synthetic oligonucleotide
tgactccgcggagtcaccc

SEQ ID NO: 13046 - DNA, 19 bp, Artificial Sequence
  Description of Artificial Sequence: Synthetic oligonucleotide
ggactccgcggagtcccgt

SEQ ID NO: 13047 - DNA, 19 bp, Artificial Sequence
  Description of Artificial Sequence: Synthetic oligonucleotide
ggactccgcggagtccctg

SEQ ID NO: 13048 - DNA, 19 bp, Artificial Sequence
  Description of Artificial Sequence: Synthetic oligonucleotide
ggactccgcggagtcctgg

SEQ ID NO: 13049 - DNA, 19 bp, Artificial Sequence
  Description of Artificial Sequence: Synthetic oligonucleotide
agactccgcggagtctcgg

SEQ ID NO: 13050 - DNA, 19 bp, Artificial Sequence
  Description of Artificial Sequence: Synthetic oligonucleotide
ggactccgcggagtcccga

SEQ ID NO: 13051 - DNA, 19 bp, Artificial Sequence
  Description of Artificial Sequence: Synthetic oligonucleotide
ggactccgcggagtcccag

SEQ ID NO: 13052 - DNA, 19 bp, Artificial Sequence
  Description of Artificial Sequence: Synthetic oligonucleotide
ggactccgcggagtccagg

SEQ ID NO: 13053 - DNA, 19 bp, Artificial Sequence
  Description of Artificial Sequence: Synthetic oligonucleotide
tgactccgcggagtcacgg

SEQ ID NO: 13054 - DNA, 19 bp, Artificial Sequence
  Description of Artificial Sequence: Synthetic oligonucleotide
cgactccgcggagtcgccg

SEQ ID NO: 13055 - DNA, 19 bp, Artificial Sequence
  Description of Artificial Sequence: Synthetic oligonucleotide
cgactccgcggagtcgctg

SEQ ID NO: 13056 - DNA, 19 bp, Artificial Sequence
  Description of Artificial Sequence: Synthetic oligonucleotide
cgactccgcggagtcgtcg

SEQ ID NO: 13057 - DNA, 19 bp, Artificial Sequence
  Description of Artificial Sequence: Synthetic oligonucleotide
agactccgcggagtctccg

SEQ ID NO: 13058 - DNA, 19 bp, Artificial Sequence
  Description of Artificial Sequence: Synthetic oligonucleotide
cgactccgcggagtcgcag

SEQ ID NO: 13059 - DNA, 19 bp, Artificial Sequence
  Description of Artificial Sequence: Synthetic oligonucleotide
tgactccgcggagtcaccg

SEQ ID NO: 13060 - DNA, 19 bp, Artificial Sequence
  Description of Artificial Sequence: Synthetic oligonucleotide
ggactccgcggagtccgtg

SEQ ID NO: 13061 - DNA, 19 bp, Artificial Sequence
  Description of Artificial Sequence: Synthetic oligonucleotide
agactccgcggagtctggg

SEQ ID NO: 13062 - DNA, 19 bp, Artificial Sequence
  Description of Artificial Sequence: Synthetic oligonucleotide
ggactccgcggagtccgag

SEQ ID NO: 13063 - DNA, 19 bp, Artificial Sequence
  Description of Artificial Sequence: Synthetic oligonucleotide
tgactccgcggagtcaggg

SEQ ID NO: 13064 - DNA, 19 bp, Artificial Sequence
  Description of Artificial Sequence: Synthetic oligonucleotide
cgactccgcggagtcgtgg

SEQ ID NO: 13065 - DNA, 19 bp, Artificial Sequence
  Description of Artificial Sequence: Synthetic oligonucleotide
cgactccgcggagtcggct

SEQ ID NO: 13066 - DNA, 19 bp, Artificial Sequence
  Description of Artificial Sequence: Synthetic oligonucleotide
cgactccgcggagtcggca

SEQ ID NO: 13067 - DNA, 19 bp, Artificial Sequence
  Description of Artificial Sequence: Synthetic oligonucleotide
agactccgcggagtctcgc

SEQ ID NO: 13068 - DNA, 19 bp, Artificial Sequence
  Description of Artificial Sequence: Synthetic oligonucleotide
tgactccgcggagtcacgc

SEQ ID NO: 13069 - DNA, 19 bp, Artificial Sequence
  Description of Artificial Sequence: Synthetic oligonucleotide
ggactccgcggagtcctgc

SEQ ID NO: 13070 - DNA, 19 bp, Artificial Sequence
  Description of Artificial Sequence: Synthetic oligonucleotide
ggactccgcggagtccagc

SEQ ID NO: 13071 - DNA, 19 bp, Artificial Sequence
  Description of Artificial Sequence: Synthetic oligonucleotide
ggactccgcggagtcctcg

SEQ ID NO: 13072 - DNA, 19 bp, Artificial Sequence
  Description of Artificial Sequence: Synthetic oligonucleotide
ggactccgcggagtccacg

SEQ ID NO: 13073 - DNA, 19 bp, Artificial Sequence
  Description of Artificial Sequence: Synthetic oligonucleotide
cgactccgcggagtcggtg

SEQ ID NO: 13074 - DNA, 19 bp, Artificial Sequence
  Description of Artificial Sequence: Synthetic oligonucleotide
cgactccgcggagtcggag

SEQ ID NO: 13075 - DNA, 19 bp, Artificial Sequence
  Description of Artificial Sequence: Synthetic oligonucleotide
ggactccgcggagtcccgc

SEQ ID NO: 13076 - DNA, 19 bp, Artificial Sequence
  Description of Artificial Sequence: Synthetic oligonucleotide
ggactccgcggagtccctc

SEQ ID NO: 13077 - DNA, 19 bp, Artificial Sequence
  Description of Artificial Sequence: Synthetic oligonucleotide
ggactccgcggagtcccac

SEQ ID NO: 13078 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactctgcagagtcnnnn

SEQ ID NO: 13079 - DNA, 19 bp, Artificial Sequence
  Description of Artificial Sequence: Synthetic oligonucleotide
ggactctgcagagtccgcc

SEQ ID NO: 13080 - DNA, 19 bp, Artificial Sequence
  Description of Artificial Sequence: Synthetic oligonucleotide
ggactctgcagagtccgct

SEQ ID NO: 13081 - DNA, 19 bp, Artificial Sequence
  Description of Artificial Sequence: Synthetic oligonucleotide
ggactctgcagagtccgtc

SEQ ID NO: 13082 - DNA, 19 bp, Artificial Sequence
  Description of Artificial Sequence: Synthetic oligonucleotide
ggactctgcagagtcctcc

SEQ ID NO: 13083 - DNA, 19 bp, Artificial Sequence
  Description of Artificial Sequence: Synthetic oligonucleotide
agactctgcagagtctgcc

SEQ ID NO: 13084 - DNA, 19 bp, Artificial Sequence
  Description of Artificial Sequence: Synthetic oligonucleotide
ggactctgcagagtccgca

SEQ ID NO: 13085 - DNA, 19 bp, Artificial Sequence
  Description of Artificial Sequence: Synthetic oligonucleotide
ggactctgcagagtccgac

SEQ ID NO: 13086 - DNA, 19 bp, Artificial Sequence
  Description of Artificial Sequence: Synthetic oligonucleotide
ggactctgcagagtccacc

SEQ ID NO: 13087 - DNA, 19 bp, Artificial Sequence
  Description of Artificial Sequence: Synthetic oligonucleotide
tgactctgcagagtcagcc

SEQ ID NO: 13088 - DNA, 19 bp, Artificial Sequence
  Description of Artificial Sequence: Synthetic oligonucleotide
cgactctgcagagtcgggc

SEQ ID NO: 13089 - DNA, 19 bp, Artificial Sequence
  Description of Artificial Sequence: Synthetic oligonucleotide
cgactctgcagagtcgggt

SEQ ID NO: 13090 - DNA, 19 bp, Artificial Sequence
  Description of Artificial Sequence: Synthetic oligonucleotide
cgactctgcagagtcggtc

SEQ ID NO: 13091 - DNA, 19 bp, Artificial Sequence
  Description of Artificial Sequence: Synthetic oligonucleotide
cgactctgcagagtcgtgc

SEQ ID NO: 13092 - DNA, 19 bp, Artificial Sequence
  Description of Artificial Sequence: Synthetic oligonucleotide
agactctgcagagtctggc

SEQ ID NO: 13093 - DNA, 19 bp, Artificial Sequence
  Description of Artificial Sequence: Synthetic oligonucleotide
cgactctgcagagtcggga

SEQ ID NO: 13094 - DNA, 19 bp, Artificial Sequence
  Description of Artificial Sequence: Synthetic oligonucleotide
cgactctgcagagtcggac

SEQ ID NO: 13095 - DNA, 19 bp, Artificial Sequence
  Description of Artificial Sequence: Synthetic oligonucleotide
tgactctgcagagtcaggc

SEQ ID NO: 13096 - DNA, 19 bp, Artificial Sequence
  Description of Artificial Sequence: Synthetic oligonucleotide
cgactctgcagagtcgccc

SEQ ID NO: 13097 - DNA, 19 bp, Artificial Sequence
  Description of Artificial Sequence: Synthetic oligonucleotide
cgactctgcagagtcgcct

SEQ ID NO: 13098 - DNA, 19 bp, Artificial Sequence
  Description of Artificial Sequence: Synthetic oligonucleotide
cgactctgcagagtcgctc

SEQ ID NO: 13099 - DNA, 19 bp, Artificial Sequence
  Description of Artificial Sequence: Synthetic oligonucleotide
cgactctgcagagtcgtcc

SEQ ID NO: 13100 - DNA, 19 bp, Artificial Sequence
  Description of Artificial Sequence: Synthetic oligonucleotide
agactctgcagagtctccc

SEQ ID NO: 13101 - DNA, 19 bp, Artificial Sequence
  Description of Artificial Sequence: Synthetic oligonucleotide
cgactctgcagagtcgcca

SEQ ID NO: 13102 - DNA, 19 bp, Artificial Sequence
  Description of Artificial Sequence: Synthetic oligonucleotide
cgactctgcagagtcgcac

SEQ ID NO: 13103 - DNA, 19 bp, Artificial Sequence
  Description of Artificial Sequence: Synthetic oligonucleotide
tgactctgcagagtcaccc

SEQ ID NO: 13104 - DNA, 19 bp, Artificial Sequence
  Description of Artificial Sequence: Synthetic oligonucleotide
ggactctgcagagtcccgt

SEQ ID NO: 13105 - DNA, 19 bp, Artificial Sequence
  Description of Artificial Sequence: Synthetic oligonucleotide
ggactctgcagagtccctg

SEQ ID NO: 13106 - DNA, 19 bp, Artificial Sequence
  Description of Artificial Sequence: Synthetic oligonucleotide
ggactctgcagagtcctgg

SEQ ID NO: 13107 - DNA, 19 bp, Artificial Sequence
  Description of Artificial Sequence: Synthetic oligonucleotide
agactctgcagagtctcgg

SEQ ID NO: 13108 - DNA, 19 bp, Artificial Sequence
  Description of Artificial Sequence: Synthetic oligonucleotide
ggactctgcagagtcccga

SEQ ID NO: 13109 - DNA, 19 bp, Artificial Sequence
  Description of Artificial Sequence: Synthetic oligonucleotide
ggactctgcagagtcccag

SEQ ID NO: 13110 - DNA, 19 bp, Artificial Sequence
  Description of Artificial Sequence: Synthetic oligonucleotide
ggactctgcagagtccagg

SEQ ID NO: 13111 - DNA, 19 bp, Artificial Sequence
  Description of Artificial Sequence: Synthetic oligonucleotide
tgactctgcagagtcacgg

SEQ ID NO: 13112 - DNA, 19 bp, Artificial Sequence
  Description of Artificial Sequence: Synthetic oligonucleotide
cgactctgcagagtcgccg

SEQ ID NO: 13113 - DNA, 19 bp, Artificial Sequence
  Description of Artificial Sequence: Synthetic oligonucleotide
cgactctgcagagtcgctg

SEQ ID NO: 13114 - DNA, 19 bp, Artificial Sequence
  Description of Artificial Sequence: Synthetic oligonucleotide
cgactctgcagagtcgtcg

SEQ ID NO: 13115 - DNA, 19 bp, Artificial Sequence
  Description of Artificial Sequence: Synthetic oligonucleotide
agactctgcagagtctccg

SEQ ID NO: 13116 - DNA, 19 bp, Artificial Sequence
  Description of Artificial Sequence: Synthetic oligonucleotide
cgactctgcagagtcgcag

SEQ ID NO: 13117 - DNA, 19 bp, Artificial Sequence
  Description of Artificial Sequence: Synthetic oligonucleotide
tgactctgcagagtcaccg

SEQ ID NO: 13118 - DNA, 19 bp, Artificial Sequence
  Description of Artificial Sequence: Synthetic oligonucleotide
ggactctgcagagtccgtg

SEQ ID NO: 13119 - DNA, 19 bp, Artificial Sequence
  Description of Artificial Sequence: Synthetic oligonucleotide
agactctgcagagtctggg

SEQ ID NO: 13120 - DNA, 19 bp, Artificial Sequence
  Description of Artificial Sequence: Synthetic oligonucleotide
ggactctgcagagtccgag

SEQ ID NO: 13121 - DNA, 19 bp, Artificial Sequence
  Description of Artificial Sequence: Synthetic oligonucleotide
tgactctgcagagtcaggg

SEQ ID NO: 13122 - DNA, 19 bp, Artificial Sequence
  Description of Artificial Sequence: Synthetic oligonucleotide
cgactctgcagagtcgtgg

SEQ ID NO: 13123 - DNA, 19 bp, Artificial Sequence
  Description of Artificial Sequence: Synthetic oligonucleotide
cgactctgcagagtcggct

SEQ ID NO: 13124 - DNA, 19 bp, Artificial Sequence
  Description of Artificial Sequence: Synthetic oligonucleotide
cgactctgcagagtcggca

SEQ ID NO: 13125 - DNA, 19 bp, Artificial Sequence
  Description of Artificial Sequence: Synthetic oligonucleotide
agactctgcagagtctcgc

SEQ ID NO: 13126 - DNA, 19 bp, Artificial Sequence
  Description of Artificial Sequence: Synthetic oligonucleotide
tgactctgcagagtcacgc

SEQ ID NO: 13127 - DNA, 19 bp, Artificial Sequence
  Description of Artificial Sequence: Synthetic oligonucleotide
ggactctgcagagtcctgc

SEQ ID NO: 13128 - DNA, 19 bp, Artificial Sequence
  Description of Artificial Sequence: Synthetic oligonucleotide
ggactctgcagagtccagc

SEQ ID NO: 13129 - DNA, 19 bp, Artificial Sequence
  Description of Artificial Sequence: Synthetic oligonucleotide
ggactctgcagagtcctcg

SEQ ID NO: 13130 - DNA, 19 bp, Artificial Sequence
  Description of Artificial Sequence: Synthetic oligonucleotide
ggactctgcagagtccacg

SEQ ID NO: 13131 - DNA, 19 bp, Artificial Sequence
  Description of Artificial Sequence: Synthetic oligonucleotide
cgactctgcagagtcggtg

SEQ ID NO: 13132 - DNA, 19 bp, Artificial Sequence
  Description of Artificial Sequence: Synthetic oligonucleotide
cgactctgcagagtcggag

SEQ ID NO: 13133 - DNA, 19 bp, Artificial Sequence
  Description of Artificial Sequence: Synthetic oligonucleotide
ggactctgcagagtcccgc

SEQ ID NO: 13134 - DNA, 19 bp, Artificial Sequence
  Description of Artificial Sequence: Synthetic oligonucleotide
ggactctgcagagtccctc

SEQ ID NO: 13135 - DNA, 19 bp, Artificial Sequence
  Description of Artificial Sequence: Synthetic oligonucleotide
ggactctgcagagtcccac

SEQ ID NO: 13136 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcgcgcgagtcnnnn

SEQ ID NO: 13137 - DNA, 19 bp, Artificial Sequence
  Description of Artificial Sequence: Synthetic oligonucleotide
ggactcgcgcgagtccgcc

SEQ ID NO: 13138 - DNA, 19 bp, Artificial Sequence
  Description of Artificial Sequence: Synthetic oligonucleotide
ggactcgcgcgagtccgct

SEQ ID NO: 13139 - DNA, 19 bp, Artificial Sequence
  Description of Artificial Sequence: Synthetic oligonucleotide
ggactcgcgcgagtccgtc

SEQ ID NO: 13140 - DNA, 19 bp, Artificial Sequence
  Description of Artificial Sequence: Synthetic oligonucleotide
ggactcgcgcgagtcctcc

SEQ ID NO: 13141 - DNA, 19 bp, Artificial Sequence
  Description of Artificial Sequence: Synthetic oligonucleotide
agactcgcgcgagtctgcc

SEQ ID NO: 13142 - DNA, 19 bp, Artificial Sequence
  Description of Artificial Sequence: Synthetic oligonucleotide
ggactcgcgcgagtccgca

SEQ ID NO: 13143 - DNA, 19 bp, Artificial Sequence
  Description of Artificial Sequence: Synthetic oligonucleotide
ggactcgcgcgagtccgac

SEQ ID NO: 13144 - DNA, 19 bp, Artificial Sequence
  Description of Artificial Sequence: Synthetic oligonucleotide
ggactcgcgcgagtccacc

SEQ ID NO: 13145 - DNA, 19 bp, Artificial Sequence
  Description of Artificial Sequence: Synthetic oligonucleotide
tgactcgcgcgagtcagcc

SEQ ID NO: 13146 - DNA, 19 bp, Artificial Sequence
  Description of Artificial Sequence: Synthetic oligonucleotide
cgactcgcgcgagtcgggc

SEQ ID NO: 13147 - DNA, 19 bp, Artificial Sequence
  Description of Artificial Sequence: Synthetic oligonucleotide
cgactcgcgcgagtcgggt

SEQ ID NO: 13148 - DNA, 19 bp, Artificial Sequence
  Description of Artificial Sequence: Synthetic oligonucleotide
cgactcgcgcgagtcggtc

SEQ ID NO: 13149 - DNA, 19 bp, Artificial Sequence
  Description of Artificial Sequence: Synthetic oligonucleotide
cgactcgcgcgagtcgtgc

SEQ ID NO: 13150 - DNA, 19 bp, Artificial Sequence
  Description of Artificial Sequence: Synthetic oligonucleotide
agactcgcgcgagtctggc

SEQ ID NO: 13151 - DNA, 19 bp, Artificial Sequence
  Description of Artificial Sequence: Synthetic oligonucleotide
cgactcgcgcgagtcggga

SEQ ID NO: 13152 - DNA, 19 bp, Artificial Sequence
  Description of Artificial Sequence: Synthetic oligonucleotide
cgactcgcgcgagtcggac

SEQ ID NO: 13153 - DNA, 19 bp, Artificial Sequence
  Description of Artificial Sequence: Synthetic oligonucleotide
tgactcgcgcgagtcaggc

SEQ ID NO: 13154 - DNA, 19 bp, Artificial Sequence
  Description of Artificial Sequence: Synthetic oligonucleotide
cgactcgcgcgagtcgccc

SEQ ID NO: 13155 - DNA, 19 bp, Artificial Sequence
  Description of Artificial Sequence: Synthetic oligonucleotide
cgactcgcgcgagtcgcct

SEQ ID NO: 13156 - DNA, 19 bp, Artificial Sequence
  Description of Artificial Sequence: Synthetic oligonucleotide
cgactcgcgcgagtcgctc

SEQ ID NO: 13157 - DNA, 19 bp, Artificial Sequence
  Description of Artificial Sequence: Synthetic oligonucleotide
cgactcgcgcgagtcgtcc

SEQ ID NO: 13158 - DNA, 19 bp, Artificial Sequence
  Description of Artificial Sequence: Synthetic oligonucleotide
agactcgcgcgagtctccc

SEQ ID NO: 13159 - DNA, 19 bp, Artificial Sequence
  Description of Artificial Sequence: Synthetic oligonucleotide
cgactcgcgcgagtcgcca

SEQ ID NO: 13160 - DNA, 19 bp, Artificial Sequence
  Description of Artificial Sequence: Synthetic oligonucleotide
cgactcgcgcgagtcgcac

SEQ ID NO: 13161 - DNA, 19 bp, Artificial Sequence
  Description of Artificial Sequence: Synthetic oligonucleotide
tgactcgcgcgagtcaccc

SEQ ID NO: 13162 - DNA, 19 bp, Artificial Sequence
  Description of Artificial Sequence: Synthetic oligonucleotide
ggactcgcgcgagtcccgt

SEQ ID NO: 13163 - DNA, 19 bp, Artificial Sequence
  Description of Artificial Sequence: Synthetic oligonucleotide
ggactcgcgcgagtccctg

SEQ ID NO: 13164 - DNA, 19 bp, Artificial Sequence
  Description of Artificial Sequence: Synthetic oligonucleotide
ggactcgcgcgagtcctgg

SEQ ID NO: 13165 - DNA, 19 bp, Artificial Sequence
  Description of Artificial Sequence: Synthetic oligonucleotide
agactcgcgcgagtctcgg

SEQ ID NO: 13166 - DNA, 19 bp, Artificial Sequence
  Description of Artificial Sequence: Synthetic oligonucleotide
ggactcgcgcgagtcccga

SEQ ID NO: 13167 - DNA, 19 bp, Artificial Sequence
  Description of Artificial Sequence: Synthetic oligonucleotide
ggactcgcgcgagtcccag

SEQ ID NO: 13168 - DNA, 19 bp, Artificial Sequence
  Description of Artificial Sequence: Synthetic oligonucleotide
ggactcgcgcgagtccagg

SEQ ID NO: 13169 - DNA, 19 bp, Artificial Sequence
  Description of Artificial Sequence: Synthetic oligonucleotide
tgactcgcgcgagtcacgg

SEQ ID NO: 13170 - DNA, 19 bp, Artificial Sequence
  Description of Artificial Sequence: Synthetic oligonucleotide
cgactcgcgcgagtcgccg

SEQ ID NO: 13171 - DNA, 19 bp, Artificial Sequence
  Description of Artificial Sequence: Synthetic oligonucleotide
cgactcgcgcgagtcgctg

SEQ ID NO: 13172 - DNA, 19 bp, Artificial Sequence
  Description of Artificial Sequence: Synthetic oligonucleotide
cgactcgcgcgagtcgtcg

SEQ ID NO: 13173 - DNA, 19 bp, Artificial Sequence
  Description of Artificial Sequence: Synthetic oligonucleotide
agactcgcgcgagtctccg

SEQ ID NO: 13174 - DNA, 19 bp, Artificial Sequence
  Description of Artificial Sequence: Synthetic oligonucleotide
cgactcgcgcgagtcgcag

SEQ ID NO: 13175 - DNA, 19 bp, Artificial Sequence
  Description of Artificial Sequence: Synthetic oligonucleotide
tgactcgcgcgagtcaccg

SEQ ID NO: 13176 - DNA, 19 bp, Artificial Sequence
  Description of Artificial Sequence: Synthetic oligonucleotide
ggactcgcgcgagtccgtg

SEQ ID NO: 13177 - DNA, 19 bp, Artificial Sequence
  Description of Artificial Sequence: Synthetic oligonucleotide
agactcgcgcgagtctggg

SEQ ID NO: 13178 - DNA, 19 bp, Artificial Sequence
  Description of Artificial Sequence: Synthetic oligonucleotide
ggactcgcgcgagtccgag

SEQ ID NO: 13179 - DNA, 19 bp, Artificial Sequence
  Description of Artificial Sequence: Synthetic oligonucleotide
tgactcgcgcgagtcaggg

SEQ ID NO: 13180 - DNA, 19 bp, Artificial Sequence
  Description of Artificial Sequence: Synthetic oligonucleotide
cgactcgcgcgagtcgtgg

SEQ ID NO: 13181 - DNA, 19 bp, Artificial Sequence
  Description of Artificial Sequence: Synthetic oligonucleotide
cgactcgcgcgagtcggct

SEQ ID NO: 13182 - DNA, 19 bp, Artificial Sequence
  Description of Artificial Sequence: Synthetic oligonucleotide
cgactcgcgcgagtcggca

SEQ ID NO: 13183 - DNA, 19 bp, Artificial Sequence
  Description of Artificial Sequence: Synthetic oligonucleotide
agactcgcgcgagtctcgc

SEQ ID NO: 13184 - DNA, 19 bp, Artificial Sequence
  Description of Artificial Sequence: Synthetic oligonucleotide
tgactcgcgcgagtcacgc

SEQ ID NO: 13185 - DNA, 19 bp, Artificial Sequence
  Description of Artificial Sequence: Synthetic oligonucleotide
ggactcgcgcgagtcctgc

SEQ ID NO: 13186 - DNA, 19 bp, Artificial Sequence
  Description of Artificial Sequence: Synthetic oligonucleotide
ggactcgcgcgagtccagc

SEQ ID NO: 13187 - DNA, 19 bp, Artificial Sequence
  Description of Artificial Sequence: Synthetic oligonucleotide
ggactcgcgcgagtcctcg

SEQ ID NO: 13188 - DNA, 19 bp, Artificial Sequence
  Description of Artificial Sequence: Synthetic oligonucleotide
ggactcgcgcgagtccacg

SEQ ID NO: 13189 - DNA, 19 bp, Artificial Sequence
  Description of Artificial Sequence: Synthetic oligonucleotide
cgactcgcgcgagtcggtg

SEQ ID NO: 13190 - DNA, 19 bp, Artificial Sequence
  Description of Artificial Sequence: Synthetic oligonucleotide
cgactcgcgcgagtcggag

SEQ ID NO: 13191 - DNA, 19 bp, Artificial Sequence
  Description of Artificial Sequence: Synthetic oligonucleotide
ggactcgcgcgagtcccgc

SEQ ID NO: 13192 - DNA, 19 bp, Artificial Sequence
  Description of Artificial Sequence: Synthetic oligonucleotide
ggactcgcgcgagtccctc

SEQ ID NO: 13193 - DNA, 19 bp, Artificial Sequence
  Description of Artificial Sequence: Synthetic oligonucleotide
ggactcgcgcgagtcccac

SEQ ID NO: 13194 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcacgtgagtcnnnn

SEQ ID NO: 13195 - DNA, 19 bp, Artificial Sequence
  Description of Artificial Sequence: Synthetic oligonucleotide
ggactcacgtgagtccgcc

SEQ ID NO: 13196 - DNA, 19 bp, Artificial Sequence
  Description of Artificial Sequence: Synthetic oligonucleotide
ggactcacgtgagtccgct

SEQ ID NO: 13197 - DNA, 19 bp, Artificial Sequence
  Description of Artificial Sequence: Synthetic oligonucleotide
ggactcacgtgagtccgtc

SEQ ID NO: 13198 - DNA, 19 bp, Artificial Sequence
  Description of Artificial Sequence: Synthetic oligonucleotide
ggactcacgtgagtcctcc

SEQ ID NO: 13199 - DNA, 19 bp, Artificial Sequence
  Description of Artificial Sequence: Synthetic oligonucleotide
agactcacgtgagtctgcc

SEQ ID NO: 13200 - DNA, 19 bp, Artificial Sequence
  Description of Artificial Sequence: Synthetic oligonucleotide
ggactcacgtgagtccgca

SEQ ID NO: 13201 - DNA, 19 bp, Artificial Sequence
  Description of Artificial Sequence: Synthetic oligonucleotide
ggactcacgtgagtccgac

SEQ ID NO: 13202 - DNA, 19 bp, Artificial Sequence
  Description of Artificial Sequence: Synthetic oligonucleotide
ggactcacgtgagtccacc

SEQ ID NO: 13203 - DNA, 19 bp, Artificial Sequence
  Description of Artificial Sequence: Synthetic oligonucleotide
tgactcacgtgagtcagcc

SEQ ID NO: 13204 - DNA, 19 bp, Artificial Sequence
  Description of Artificial Sequence: Synthetic oligonucleotide
cgactcacgtgagtcgggc

SEQ ID NO: 13205 - DNA, 19 bp, Artificial Sequence
  Description of Artificial Sequence: Synthetic oligonucleotide
cgactcacgtgagtcgggt

SEQ ID NO: 13206 - DNA, 19 bp, Artificial Sequence
  Description of Artificial Sequence: Synthetic oligonucleotide
cgactcacgtgagtcggtc

SEQ ID NO: 13207 - DNA, 19 bp, Artificial Sequence
  Description of Artificial Sequence: Synthetic oligonucleotide
cgactcacgtgagtcgtgc

SEQ ID NO: 13208 - DNA, 19 bp, Artificial Sequence
  Description of Artificial Sequence: Synthetic oligonucleotide
agactcacgtgagtctggc

SEQ ID NO: 13209 - DNA, 19 bp, Artificial Sequence
  Description of Artificial Sequence: Synthetic oligonucleotide
cgactcacgtgagtcggga

SEQ ID NO: 13210 - DNA, 19 bp, Artificial Sequence
  Description of Artificial Sequence: Synthetic oligonucleotide
cgactcacgtgagtcggac

SEQ ID NO: 13211 - DNA, 19 bp, Artificial Sequence
  Description of Artificial Sequence: Synthetic oligonucleotide
tgactcacgtgagtcaggc

SEQ ID NO: 13212 - DNA, 19 bp, Artificial Sequence
  Description of Artificial Sequence: Synthetic oligonucleotide
cgactcacgtgagtcgccc

SEQ ID NO: 13213 - DNA, 19 bp, Artificial Sequence
  Description of Artificial Sequence: Synthetic oligonucleotide
cgactcacgtgagtcgcct

SEQ ID NO: 13214 - DNA, 19 bp, Artificial Sequence
  Description of Artificial Sequence: Synthetic oligonucleotide
cgactcacgtgagtcgctc

SEQ ID NO: 13215 - DNA, 19 bp, Artificial Sequence
  Description of Artificial Sequence: Synthetic oligonucleotide
cgactcacgtgagtcgtcc

SEQ ID NO: 13216 - DNA, 19 bp, Artificial Sequence
  Description of Artificial Sequence: Synthetic oligonucleotide
agactcacgtgagtctccc

SEQ ID NO: 13217 - DNA, 19 bp, Artificial Sequence
  Description of Artificial Sequence: Synthetic oligonucleotide
cgactcacgtgagtcgcca

SEQ ID NO: 13218 - DNA, 19 bp, Artificial Sequence
  Description of Artificial Sequence: Synthetic oligonucleotide
cgactcacgtgagtcgcac

SEQ ID NO: 13219 - DNA, 19 bp, Artificial Sequence
  Description of Artificial Sequence: Synthetic oligonucleotide
tgactcacgtgagtcaccc

SEQ ID NO: 13220 - DNA, 19 bp, Artificial Sequence
  Description of Artificial Sequence: Synthetic oligonucleotide
ggactcacgtgagtcccgt

SEQ ID NO: 13221 - DNA, 19 bp, Artificial Sequence
  Description of Artificial Sequence: Synthetic oligonucleotide
ggactcacgtgagtccctg

SEQ ID NO: 13222 - DNA, 19 bp, Artificial Sequence
  Description of Artificial Sequence: Synthetic oligonucleotide
ggactcacgtgagtcctgg

SEQ ID NO: 13223 - DNA, 19 bp, Artificial Sequence
  Description of Artificial Sequence: Synthetic oligonucleotide
agactcacgtgagtctcgg

SEQ ID NO: 13224 - DNA, 19 bp, Artificial Sequence
  Description of Artificial Sequence: Synthetic oligonucleotide
ggactcacgtgagtcccga

SEQ ID NO: 13225 - DNA, 19 bp, Artificial Sequence
  Description of Artificial Sequence: Synthetic oligonucleotide
ggactcacgtgagtcccag

SEQ ID NO: 13226 - DNA, 19 bp, Artificial Sequence
  Description of Artificial Sequence: Synthetic oligonucleotide
ggactcacgtgagtccagg

SEQ ID NO: 13227 - DNA, 19 bp, Artificial Sequence
  Description of Artificial Sequence: Synthetic oligonucleotide
tgactcacgtgagtcacgg

SEQ ID NO: 13228 - DNA, 19 bp, Artificial Sequence
  Description of Artificial Sequence: Synthetic oligonucleotide
cgactcacgtgagtcgccg

SEQ ID NO: 13229 - DNA, 19 bp, Artificial Sequence
  Description of Artificial Sequence: Synthetic oligonucleotide
cgactcacgtgagtcgctg

SEQ ID NO: 13230 - DNA, 19 bp, Artificial Sequence
  Description of Artificial Sequence: Synthetic oligonucleotide
cgactcacgtgagtcgtcg

SEQ ID NO: 13231 - DNA, 19 bp, Artificial Sequence
  Description of Artificial Sequence: Synthetic oligonucleotide
agactcacgtgagtctccg

SEQ ID NO: 13232 - DNA, 19 bp, Artificial Sequence
  Description of Artificial Sequence: Synthetic oligonucleotide
cgactcacgtgagtcgcag

SEQ ID NO: 13233 - DNA, 19 bp, Artificial Sequence
  Description of Artificial Sequence: Synthetic oligonucleotide
tgactcacgtgagtcaccg

SEQ ID NO: 13234 - DNA, 19 bp, Artificial Sequence
  Description of Artificial Sequence: Synthetic oligonucleotide
ggactcacgtgagtccgtg

SEQ ID NO: 13235 - DNA, 19 bp, Artificial Sequence
  Description of Artificial Sequence: Synthetic oligonucleotide
agactcacgtgagtctggg

SEQ ID NO: 13236 - DNA, 19 bp, Artificial Sequence
  Description of Artificial Sequence: Synthetic oligonucleotide
ggactcacgtgagtccgag

SEQ ID NO: 13237 - DNA, 19 bp, Artificial Sequence
  Description of Artificial Sequence: Synthetic oligonucleotide
tgactcacgtgagtcaggg

SEQ ID NO: 13238 - DNA, 19 bp, Artificial Sequence
  Description of Artificial Sequence: Synthetic oligonucleotide
cgactcacgtgagtcgtgg

SEQ ID NO: 13239 - DNA, 19 bp, Artificial Sequence
  Description of Artificial Sequence: Synthetic oligonucleotide
cgactcacgtgagtcggct

SEQ ID NO: 13240 - DNA, 19 bp, Artificial Sequence
  Description of Artificial Sequence: Synthetic oligonucleotide
cgactcacgtgagtcggca

SEQ ID NO: 13241 - DNA, 19 bp, Artificial Sequence
  Description of Artificial Sequence: Synthetic oligonucleotide
agactcacgtgagtctcgc

SEQ ID NO: 13242 - DNA, 19 bp, Artificial Sequence
  Description of Artificial Sequence: Synthetic oligonucleotide
tgactcacgtgagtcacgc

SEQ ID NO: 13243 - DNA, 19 bp, Artificial Sequence
  Description of Artificial Sequence: Synthetic oligonucleotide
ggactcacgtgagtcctgc

SEQ ID NO: 13244 - DNA, 19 bp, Artificial Sequence
  Description of Artificial Sequence: Synthetic oligonucleotide
ggactcacgtgagtccagc

SEQ ID NO: 13245 - DNA, 19 bp, Artificial Sequence
  Description of Artificial Sequence: Synthetic oligonucleotide
ggactcacgtgagtcctcg

SEQ ID NO: 13246 - DNA, 19 bp, Artificial Sequence
  Description of Artificial Sequence: Synthetic oligonucleotide
ggactcacgtgagtccacg

SEQ ID NO: 13247 - DNA, 19 bp, Artificial Sequence
  Description of Artificial Sequence: Synthetic oligonucleotide
cgactcacgtgagtcggtg

SEQ ID NO: 13248 - DNA, 19 bp, Artificial Sequence
  Description of Artificial Sequence: Synthetic oligonucleotide
cgactcacgtgagtcggag

SEQ ID NO: 13249 - DNA, 19 bp, Artificial Sequence
  Description of Artificial Sequence: Synthetic oligonucleotide
ggactcacgtgagtcccgc

SEQ ID NO: 13250 - DNA, 19 bp, Artificial Sequence
  Description of Artificial Sequence: Synthetic oligonucleotide
ggactcacgtgagtccctc

SEQ ID NO: 13251 - DNA, 19 bp, Artificial Sequence
  Description of Artificial Sequence: Synthetic oligonucleotide
ggactcacgtgagtcccac

SEQ ID NO: 13252 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcggccgagtcnnnn

SEQ ID NO: 13253 - DNA, 19 bp, Artificial Sequence
  Description of Artificial Sequence: Synthetic oligonucleotide
ggactcggccgagtccgcc

SEQ ID NO: 13254 - DNA, 19 bp, Artificial Sequence
  Description of Artificial Sequence: Synthetic oligonucleotide
ggactcggccgagtccgct

SEQ ID NO: 13255 - DNA, 19 bp, Artificial Sequence
  Description of Artificial Sequence: Synthetic oligonucleotide
ggactcggccgagtccgtc

SEQ ID NO: 13256 - DNA, 19 bp, Artificial Sequence
  Description of Artificial Sequence: Synthetic oligonucleotide
ggactcggccgagtcctcc

SEQ ID NO: 13257 - DNA, 19 bp, Artificial Sequence
  Description of Artificial Sequence: Synthetic oligonucleotide
agactcggccgagtctgcc

SEQ ID NO: 13258 - DNA, 19 bp, Artificial Sequence
  Description of Artificial Sequence: Synthetic oligonucleotide
ggactcggccgagtccgca

SEQ ID NO: 13259 - DNA, 19 bp, Artificial Sequence
  Description of Artificial Sequence: Synthetic oligonucleotide
ggactcggccgagtccgac

SEQ ID NO: 13260 - DNA, 19 bp, Artificial Sequence
  Description of Artificial Sequence: Synthetic oligonucleotide
ggactcggccgagtccacc

SEQ ID NO: 13261 - DNA, 19 bp, Artificial Sequence
  Description of Artificial Sequence: Synthetic oligonucleotide
tgactcggccgagtcagcc

SEQ ID NO: 13262 - DNA, 19 bp, Artificial Sequence
  Description of Artificial Sequence: Synthetic oligonucleotide
cgactcggccgagtcgggc

SEQ ID NO: 13263 - DNA, 19 bp, Artificial Sequence
  Description of Artificial Sequence: Synthetic oligonucleotide
cgactcggccgagtcgggt

SEQ ID NO: 13264 - DNA, 19 bp, Artificial Sequence
  Description of Artificial Sequence: Synthetic oligonucleotide
cgactcggccgagtcggtc

SEQ ID NO: 13265 - DNA, 19 bp, Artificial Sequence
  Description of Artificial Sequence: Synthetic oligonucleotide
cgactcggccgagtcgtgc

SEQ ID NO: 13266 - DNA, 19 bp, Artificial Sequence
  Description of Artificial Sequence: Synthetic oligonucleotide
agactcggccgagtctggc

SEQ ID NO: 13267 - DNA, 19 bp, Artificial Sequence
  Description of Artificial Sequence: Synthetic oligonucleotide
cgactcggccgagtcggga

SEQ ID NO: 13268 - DNA, 19 bp, Artificial Sequence
  Description of Artificial Sequence: Synthetic oligonucleotide
cgactcggccgagtcggac

SEQ ID NO: 13269 - DNA, 19 bp, Artificial Sequence
  Description of Artificial Sequence: Synthetic oligonucleotide
tgactcggccgagtcaggc

SEQ ID NO: 13270 - DNA, 19 bp, Artificial Sequence
  Description of Artificial Sequence: Synthetic oligonucleotide
cgactcggccgagtcgccc

SEQ ID NO: 13271 - DNA, 19 bp, Artificial Sequence
  Description of Artificial Sequence: Synthetic oligonucleotide
cgactcggccgagtcgcct

SEQ ID NO: 13272 - DNA, 19 bp, Artificial Sequence
  Description of Artificial Sequence: Synthetic oligonucleotide
cgactcggccgagtcgctc

SEQ ID NO: 13273 - DNA, 19 bp, Artificial Sequence
  Description of Artificial Sequence: Synthetic oligonucleotide
cgactcggccgagtcgtcc

SEQ ID NO: 13274 - DNA, 19 bp, Artificial Sequence
  Description of Artificial Sequence: Synthetic oligonucleotide
agactcggccgagtctccc

SEQ ID NO: 13275 - DNA, 19 bp, Artificial Sequence
  Description of Artificial Sequence: Synthetic oligonucleotide
cgactcggccgagtcgcca

SEQ ID NO: 13276 - DNA, 19 bp, Artificial Sequence
  Description of Artificial Sequence: Synthetic oligonucleotide
cgactcggccgagtcgcac

SEQ ID NO: 13277 - DNA, 19 bp, Artificial Sequence
  Description of Artificial Sequence: Synthetic oligonucleotide
tgactcggccgagtcaccc

SEQ ID NO: 13278 - DNA, 19 bp, Artificial Sequence
  Description of Artificial Sequence: Synthetic oligonucleotide
ggactcggccgagtcccgt

SEQ ID NO: 13279 - DNA, 19 bp, Artificial Sequence
  Description of Artificial Sequence: Synthetic oligonucleotide
ggactcggccgagtccctg

SEQ ID NO: 13280 - DNA, 19 bp, Artificial Sequence
  Description of Artificial Sequence: Synthetic oligonucleotide
ggactcggccgagtcctgg

SEQ ID NO: 13281 - DNA, 19 bp, Artificial Sequence
  Description of Artificial Sequence: Synthetic oligonucleotide
agactcggccgagtctcgg

SEQ ID NO: 13282 - DNA, 19 bp, Artificial Sequence
  Description of Artificial Sequence: Synthetic oligonucleotide
ggactcggccgagtcccga

SEQ ID NO: 13283 - DNA, 19 bp, Artificial Sequence
  Description of Artificial Sequence: Synthetic oligonucleotide
ggactcggccgagtcccag

SEQ ID NO: 13284 - DNA, 19 bp, Artificial Sequence
  Description of Artificial Sequence: Synthetic oligonucleotide
ggactcggccgagtccagg

SEQ ID NO: 13285 - DNA, 19 bp, Artificial Sequence
  Description of Artificial Sequence: Synthetic oligonucleotide
tgactcggccgagtcacgg

SEQ ID NO: 13286 - DNA, 19 bp, Artificial Sequence
  Description of Artificial Sequence: Synthetic oligonucleotide
cgactcggccgagtcgccg

SEQ ID NO: 13287 - DNA, 19 bp, Artificial Sequence
  Description of Artificial Sequence: Synthetic oligonucleotide
cgactcggccgagtcgctg

SEQ ID NO: 13288 - DNA, 19 bp, Artificial Sequence
  Description of Artificial Sequence: Synthetic oligonucleotide
cgactcggccgagtcgtcg

SEQ ID NO: 13289 - DNA, 19 bp, Artificial Sequence
  Description of Artificial Sequence: Synthetic oligonucleotide
agactcggccgagtctccg

SEQ ID NO: 13290 - DNA, 19 bp, Artificial Sequence
  Description of Artificial Sequence: Synthetic oligonucleotide
cgactcggccgagtcgcag

SEQ ID NO: 13291 - DNA, 19 bp, Artificial Sequence
  Description of Artificial Sequence: Synthetic oligonucleotide
tgactcggccgagtcaccg

SEQ ID NO: 13292 - DNA, 19 bp, Artificial Sequence
  Description of Artificial Sequence: Synthetic oligonucleotide
ggactcggccgagtccgtg

SEQ ID NO: 13293 - DNA, 19 bp, Artificial Sequence
  Description of Artificial Sequence: Synthetic oligonucleotide
agactcggccgagtctggg

SEQ ID NO: 13294 - DNA, 19 bp, Artificial Sequence
  Description of Artificial Sequence: Synthetic oligonucleotide
ggactcggccgagtccgag

SEQ ID NO: 13295 - DNA, 19 bp, Artificial Sequence
  Description of Artificial Sequence: Synthetic oligonucleotide
tgactcggccgagtcaggg

SEQ ID NO: 13296 - DNA, 19 bp, Artificial Sequence
  Description of Artificial Sequence: Synthetic oligonucleotide
cgactcggccgagtcgtgg

SEQ ID NO: 13297 - DNA, 19 bp, Artificial Sequence
  Description of Artificial Sequence: Synthetic oligonucleotide
cgactcggccgagtcggct

SEQ ID NO: 13298 - DNA, 19 bp, Artificial Sequence
  Description of Artificial Sequence: Synthetic oligonucleotide
cgactcggccgagtcggca

SEQ ID NO: 13299 - DNA, 19 bp, Artificial Sequence
  Description of Artificial Sequence: Synthetic oligonucleotide
agactcggccgagtctcgc

SEQ ID NO: 13300 - DNA, 19 bp, Artificial Sequence
  Description of Artificial Sequence: Synthetic oligonucleotide
tgactcggccgagtcacgc

SEQ ID NO: 13301 - DNA, 19 bp, Artificial Sequence
  Description of Artificial Sequence: Synthetic oligonucleotide
ggactcggccgagtcctgc

SEQ ID NO: 13302 - DNA, 19 bp, Artificial Sequence
  Description of Artificial Sequence: Synthetic oligonucleotide
ggactcggccgagtccagc

SEQ ID NO: 13303 - DNA, 19 bp, Artificial Sequence
  Description of Artificial Sequence: Synthetic oligonucleotide
ggactcggccgagtcctcg

SEQ ID NO: 13304 - DNA, 19 bp, Artificial Sequence
  Description of Artificial Sequence: Synthetic oligonucleotide
ggactcggccgagtccacg

SEQ ID NO: 13305 - DNA, 19 bp, Artificial Sequence
  Description of Artificial Sequence: Synthetic oligonucleotide
cgactcggccgagtcggtg

SEQ ID NO: 13306 - DNA, 19 bp, Artificial Sequence
  Description of Artificial Sequence: Synthetic oligonucleotide
cgactcggccgagtcggag

SEQ ID NO: 13307 - DNA, 19 bp, Artificial Sequence
  Description of Artificial Sequence: Synthetic oligonucleotide
ggactcggccgagtcccgc

SEQ ID NO: 13308 - DNA, 19 bp, Artificial Sequence
  Description of Artificial Sequence: Synthetic oligonucleotide
ggactcggccgagtccctc

SEQ ID NO: 13309 - DNA, 19 bp, Artificial Sequence
  Description of Artificial Sequence: Synthetic oligonucleotide
ggactcggccgagtcccac

SEQ ID NO: 13310 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcccgggagtcnnnn

SEQ ID NO: 13311 - DNA, 19 bp, Artificial Sequence
  Description of Artificial Sequence: Synthetic oligonucleotide
ggactcccgggagtccgcc

SEQ ID NO: 13312 - DNA, 19 bp, Artificial Sequence
  Description of Artificial Sequence: Synthetic oligonucleotide
ggactcccgggagtccgct

SEQ ID NO: 13313 - DNA, 19 bp, Artificial Sequence
  Description of Artificial Sequence: Synthetic oligonucleotide
ggactcccgggagtccgtc

SEQ ID NO: 13314 - DNA, 19 bp, Artificial Sequence
  Description of Artificial Sequence: Synthetic oligonucleotide
ggactcccgggagtcctcc

SEQ ID NO: 13315 - DNA, 19 bp, Artificial Sequence
  Description of Artificial Sequence: Synthetic oligonucleotide
agactcccgggagtctgcc

SEQ ID NO: 13316 - DNA, 19 bp, Artificial Sequence
  Description of Artificial Sequence: Synthetic oligonucleotide
ggactcccgggagtccgca

SEQ ID NO: 13317 - DNA, 19 bp, Artificial Sequence
  Description of Artificial Sequence: Synthetic oligonucleotide
ggactcccgggagtccgac

SEQ ID NO: 13318 - DNA, 19 bp, Artificial Sequence
  Description of Artificial Sequence: Synthetic oligonucleotide
ggactcccgggagtccacc

SEQ ID NO: 13319 - DNA, 19 bp, Artificial Sequence
  Description of Artificial Sequence: Synthetic oligonucleotide
tgactcccgggagtcagcc

SEQ ID NO: 13320 - DNA, 19 bp, Artificial Sequence
  Description of Artificial Sequence: Synthetic oligonucleotide
cgactcccgggagtcgggc

SEQ ID NO: 13321 - DNA, 19 bp, Artificial Sequence
  Description of Artificial Sequence: Synthetic oligonucleotide
cgactcccgggagtcgggt

SEQ ID NO: 13322 - DNA, 19 bp, Artificial Sequence
  Description of Artificial Sequence: Synthetic oligonucleotide
cgactcccgggagtcggtc

SEQ ID NO: 13323 - DNA, 19 bp, Artificial Sequence
  Description of Artificial Sequence: Synthetic oligonucleotide
cgactcccgggagtcgtgc

SEQ ID NO: 13324 - DNA, 19 bp, Artificial Sequence
  Description of Artificial Sequence: Synthetic oligonucleotide
agactcccgggagtctggc

SEQ ID NO: 13325 - DNA, 19 bp, Artificial Sequence
  Description of Artificial Sequence: Synthetic oligonucleotide
cgactcccgggagtcggga

SEQ ID NO: 13326 - DNA, 19 bp, Artificial Sequence
  Description of Artificial Sequence: Synthetic oligonucleotide
cgactcccgggagtcggac

SEQ ID NO: 13327 - DNA, 19 bp, Artificial Sequence
  Description of Artificial Sequence: Synthetic oligonucleotide
tgactcccgggagtcaggc

SEQ ID NO: 13328 - DNA, 19 bp, Artificial Sequence
  Description of Artificial Sequence: Synthetic oligonucleotide
cgactcccgggagtcgccc

SEQ ID NO: 13329 - DNA, 19 bp, Artificial Sequence
  Description of Artificial Sequence: Synthetic oligonucleotide
cgactcccgggagtcgcct

SEQ ID NO: 13330 - DNA, 19 bp, Artificial Sequence
  Description of Artificial Sequence: Synthetic oligonucleotide
cgactcccgggagtcgctc

SEQ ID NO: 13331 - DNA, 19 bp, Artificial Sequence
  Description of Artificial Sequence: Synthetic oligonucleotide
cgactcccgggagtcgtcc

SEQ ID NO: 13332 - DNA, 19 bp, Artificial Sequence
  Description of Artificial Sequence: Synthetic oligonucleotide
agactcccgggagtctccc

SEQ ID NO: 13333 - DNA, 19 bp, Artificial Sequence
  Description of Artificial Sequence: Synthetic oligonucleotide
cgactcccgggagtcgcca

SEQ ID NO: 13334 - DNA, 19 bp, Artificial Sequence
  Description of Artificial Sequence: Synthetic oligonucleotide
cgactcccgggagtcgcac

SEQ ID NO: 13335 - DNA, 19 bp, Artificial Sequence
  Description of Artificial Sequence: Synthetic oligonucleotide
tgactcccgggagtcaccc

SEQ ID NO: 13336 - DNA, 19 bp, Artificial Sequence
  Description of Artificial Sequence: Synthetic oligonucleotide
ggactcccgggagtcccgt

SEQ ID NO: 13337 - DNA, 19 bp, Artificial Sequence
  Description of Artificial Sequence: Synthetic oligonucleotide
ggactcccgggagtccctg

SEQ ID NO: 13338 - DNA, 19 bp, Artificial Sequence
  Description of Artificial Sequence: Synthetic oligonucleotide
ggactcccgggagtcctgg

SEQ ID NO: 13339 - DNA, 19 bp, Artificial Sequence
  Description of Artificial Sequence: Synthetic oligonucleotide
agactcccgggagtctcgg

SEQ ID NO: 13340 - DNA, 19 bp, Artificial Sequence
  Description of Artificial Sequence: Synthetic oligonucleotide
ggactcccgggagtcccga

SEQ ID NO: 13341 - DNA, 19 bp, Artificial Sequence
  Description of Artificial Sequence: Synthetic oligonucleotide
ggactcccgggagtcccag

SEQ ID NO: 13342 - DNA, 19 bp, Artificial Sequence
  Description of Artificial Sequence: Synthetic oligonucleotide
ggactcccgggagtccagg

SEQ ID NO: 13343 - DNA, 19 bp, Artificial Sequence
  Description of Artificial Sequence: Synthetic oligonucleotide
tgactcccgggagtcacgg

SEQ ID NO: 13344 - DNA, 19 bp, Artificial Sequence
  Description of Artificial Sequence: Synthetic oligonucleotide
cgactcccgggagtcgccg

SEQ ID NO: 13345 - DNA, 19 bp, Artificial Sequence
  Description of Artificial Sequence: Synthetic oligonucleotide
cgactcccgggagtcgctg

SEQ ID NO: 13346 - DNA, 19 bp, Artificial Sequence
  Description of Artificial Sequence: Synthetic oligonucleotide
cgactcccgggagtcgtcg

SEQ ID NO: 13347 - DNA, 19 bp, Artificial Sequence
  Description of Artificial Sequence: Synthetic oligonucleotide
agactcccgggagtctccg

SEQ ID NO: 13348 - DNA, 19 bp, Artificial Sequence
  Description of Artificial Sequence: Synthetic oligonucleotide
cgactcccgggagtcgcag

SEQ ID NO: 13349 - DNA, 19 bp, Artificial Sequence
  Description of Artificial Sequence: Synthetic oligonucleotide
tgactcccgggagtcaccg

SEQ ID NO: 13350 - DNA, 19 bp, Artificial Sequence
  Description of Artificial Sequence: Synthetic oligonucleotide
ggactcccgggagtccgtg

SEQ ID NO: 13351 - DNA, 19 bp, Artificial Sequence
  Description of Artificial Sequence: Synthetic oligonucleotide
agactcccgggagtctggg

SEQ ID NO: 13352 - DNA, 19 bp, Artificial Sequence
  Description of Artificial Sequence: Synthetic oligonucleotide
ggactcccgggagtccgag

SEQ ID NO: 13353 - DNA, 19 bp, Artificial Sequence
  Description of Artificial Sequence: Synthetic oligonucleotide
tgactcccgggagtcaggg

SEQ ID NO: 13354 - DNA, 19 bp, Artificial Sequence
  Description of Artificial Sequence: Synthetic oligonucleotide
cgactcccgggagtcgtgg

SEQ ID NO: 13355 - DNA, 19 bp, Artificial Sequence
  Description of Artificial Sequence: Synthetic oligonucleotide
cgactcccgggagtcggct

SEQ ID NO: 13356 - DNA, 19 bp, Artificial Sequence
  Description of Artificial Sequence: Synthetic oligonucleotide
cgactcccgggagtcggca

SEQ ID NO: 13357 - DNA, 19 bp, Artificial Sequence
  Description of Artificial Sequence: Synthetic oligonucleotide
agactcccgggagtctcgc

SEQ ID NO: 13358 - DNA, 19 bp, Artificial Sequence
  Description of Artificial Sequence: Synthetic oligonucleotide
tgactcccgggagtcacgc

SEQ ID NO: 13359 - DNA, 19 bp, Artificial Sequence
  Description of Artificial Sequence: Synthetic oligonucleotide
ggactcccgggagtcctgc

SEQ ID NO: 13360 - DNA, 19 bp, Artificial Sequence
  Description of Artificial Sequence: Synthetic oligonucleotide
ggactcccgggagtccagc

SEQ ID NO: 13361 - DNA, 19 bp, Artificial Sequence
  Description of Artificial Sequence: Synthetic oligonucleotide
ggactcccgggagtcctcg

SEQ ID NO: 13362 - DNA, 19 bp, Artificial Sequence
  Description of Artificial Sequence: Synthetic oligonucleotide
ggactcccgggagtccacg

SEQ ID NO: 13363 - DNA, 19 bp, Artificial Sequence
  Description of Artificial Sequence: Synthetic oligonucleotide
cgactcccgggagtcggtg

SEQ ID NO: 13364 - DNA, 19 bp, Artificial Sequence
  Description of Artificial Sequence: Synthetic oligonucleotide
cgactcccgggagtcggag

SEQ ID NO: 13365 - DNA, 19 bp, Artificial Sequence
  Description of Artificial Sequence: Synthetic oligonucleotide
ggactcccgggagtcccgc

SEQ ID NO: 13366 - DNA, 19 bp, Artificial Sequence
  Description of Artificial Sequence: Synthetic oligonucleotide
ggactcccgggagtccctc

SEQ ID NO: 13367 - DNA, 19 bp, Artificial Sequence
  Description of Artificial Sequence: Synthetic oligonucleotide
ggactcccgggagtcccac

SEQ ID NO: 13368 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcgtacgagtcnnnn

SEQ ID NO: 13369 - DNA, 19 bp, Artificial Sequence
  Description of Artificial Sequence: Synthetic oligonucleotide
ggactcgtacgagtccgcc

SEQ ID NO: 13370 - DNA, 19 bp, Artificial Sequence
  Description of Artificial Sequence: Synthetic oligonucleotide
ggactcgtacgagtccgct

SEQ ID NO: 13371 - DNA, 19 bp, Artificial Sequence
  Description of Artificial Sequence: Synthetic oligonucleotide
ggactcgtacgagtccgtc

SEQ ID NO: 13372 - DNA, 19 bp, Artificial Sequence
  Description of Artificial Sequence: Synthetic oligonucleotide
ggactcgtacgagtcctcc

SEQ ID NO: 13373 - DNA, 19 bp, Artificial Sequence
  Description of Artificial Sequence: Synthetic oligonucleotide
agactcgtacgagtctgcc

SEQ ID NO: 13374 - DNA, 19 bp, Artificial Sequence
  Description of Artificial Sequence: Synthetic oligonucleotide
ggactcgtacgagtccgca

SEQ ID NO: 13375 - DNA, 19 bp, Artificial Sequence
  Description of Artificial Sequence: Synthetic oligonucleotide
ggactcgtacgagtccgac

SEQ ID NO: 13376 - DNA, 19 bp, Artificial Sequence
  Description of Artificial Sequence: Synthetic oligonucleotide
ggactcgtacgagtccacc

SEQ ID NO: 13377 - DNA, 19 bp, Artificial Sequence
  Description of Artificial Sequence: Synthetic oligonucleotide
tgactcgtacgagtcagcc

SEQ ID NO: 13378 - DNA, 19 bp, Artificial Sequence
  Description of Artificial Sequence: Synthetic oligonucleotide
cgactcgtacgagtcgggc

SEQ ID NO: 13379 - DNA, 19 bp, Artificial Sequence
  Description of Artificial Sequence: Synthetic oligonucleotide
cgactcgtacgagtcgggt

SEQ ID NO: 13380 - DNA, 19 bp, Artificial Sequence
  Description of Artificial Sequence: Synthetic oligonucleotide
cgactcgtacgagtcggtc

SEQ ID NO: 13381 - DNA, 19 bp, Artificial Sequence
  Description of Artificial Sequence: Synthetic oligonucleotide
cgactcgtacgagtcgtgc

SEQ ID NO: 13382 - DNA, 19 bp, Artificial Sequence
  Description of Artificial Sequence: Synthetic oligonucleotide
agactcgtacgagtctggc

SEQ ID NO: 13383 - DNA, 19 bp, Artificial Sequence
  Description of Artificial Sequence: Synthetic oligonucleotide
cgactcgtacgagtcggga

SEQ ID NO: 13384 - DNA, 19 bp, Artificial Sequence
  Description of Artificial Sequence: Synthetic oligonucleotide
cgactcgtacgagtcggac

SEQ ID NO: 13385 - DNA, 19 bp, Artificial Sequence
  Description of Artificial Sequence: Synthetic oligonucleotide
tgactcgtacgagtcaggc

SEQ ID NO: 13386 - DNA, 19 bp, Artificial Sequence
  Description of Artificial Sequence: Synthetic oligonucleotide
cgactcgtacgagtcgccc

SEQ ID NO: 13387 - DNA, 19 bp, Artificial Sequence
  Description of Artificial Sequence: Synthetic oligonucleotide
cgactcgtacgagtcgcct

SEQ ID NO: 13388 - DNA, 19 bp, Artificial Sequence
  Description of Artificial Sequence: Synthetic oligonucleotide
cgactcgtacgagtcgctc

SEQ ID NO: 13389 - DNA, 19 bp, Artificial Sequence
  Description of Artificial Sequence: Synthetic oligonucleotide
cgactcgtacgagtcgtcc

SEQ ID NO: 13390 - DNA, 19 bp, Artificial Sequence
  Description of Artificial Sequence: Synthetic oligonucleotide
agactcgtacgagtctccc

SEQ ID NO: 13391 - DNA, 19 bp, Artificial Sequence
  Description of Artificial Sequence: Synthetic oligonucleotide
cgactcgtacgagtcgcca

SEQ ID NO: 13392 - DNA, 19 bp, Artificial Sequence
  Description of Artificial Sequence: Synthetic oligonucleotide
cgactcgtacgagtcgcac

SEQ ID NO: 13393 - DNA, 19 bp, Artificial Sequence
  Description of Artificial Sequence: Synthetic oligonucleotide
tgactcgtacgagtcaccc

SEQ ID NO: 13394 - DNA, 19 bp, Artificial Sequence
  Description of Artificial Sequence: Synthetic oligonucleotide
ggactcgtacgagtcccgt

SEQ ID NO: 13395 - DNA, 19 bp, Artificial Sequence
  Description of Artificial Sequence: Synthetic oligonucleotide
ggactcgtacgagtccctg

SEQ ID NO: 13396 - DNA, 19 bp, Artificial Sequence
  Description of Artificial Sequence: Synthetic oligonucleotide
ggactcgtacgagtcctgg

SEQ ID NO: 13397 - DNA, 19 bp, Artificial Sequence
  Description of Artificial Sequence: Synthetic oligonucleotide
agactcgtacgagtctcgg

SEQ ID NO: 13398 - DNA, 19 bp, Artificial Sequence
  Description of Artificial Sequence: Synthetic oligonucleotide
ggactcgtacgagtcccga

SEQ ID NO: 13399 - DNA, 19 bp, Artificial Sequence
  Description of Artificial Sequence: Synthetic oligonucleotide
ggactcgtacgagtcccag

SEQ ID NO: 13400 - DNA, 19 bp, Artificial Sequence
  Description of Artificial Sequence: Synthetic oligonucleotide
ggactcgtacgagtccagg

SEQ ID NO: 13401 - DNA, 19 bp, Artificial Sequence
  Description of Artificial Sequence: Synthetic oligonucleotide
tgactcgtacgagtcacgg

SEQ ID NO: 13402 - DNA, 19 bp, Artificial Sequence
  Description of Artificial Sequence: Synthetic oligonucleotide
cgactcgtacgagtcgccg

SEQ ID NO: 13403 - DNA, 19 bp, Artificial Sequence
  Description of Artificial Sequence: Synthetic oligonucleotide
cgactcgtacgagtcgctg

SEQ ID NO: 13404 - DNA, 19 bp, Artificial Sequence
  Description of Artificial Sequence: Synthetic oligonucleotide
cgactcgtacgagtcgtcg

SEQ ID NO: 13405 - DNA, 19 bp, Artificial Sequence
  Description of Artificial Sequence: Synthetic oligonucleotide
agactcgtacgagtctccg

SEQ ID NO: 13406 - DNA, 19 bp, Artificial Sequence
  Description of Artificial Sequence: Synthetic oligonucleotide
cgactcgtacgagtcgcag

SEQ ID NO: 13407 - DNA, 19 bp, Artificial Sequence
  Description of Artificial Sequence: Synthetic oligonucleotide
tgactcgtacgagtcaccg

SEQ ID NO: 13408 - DNA, 19 bp, Artificial Sequence
  Description of Artificial Sequence: Synthetic oligonucleotide
ggactcgtacgagtccgtg

SEQ ID NO: 13409 - DNA, 19 bp, Artificial Sequence
  Description of Artificial Sequence: Synthetic oligonucleotide
agactcgtacgagtctggg

SEQ ID NO: 13410 - DNA, 19 bp, Artificial Sequence
  Description of Artificial Sequence: Synthetic oligonucleotide
ggactcgtacgagtccgag

SEQ ID NO: 13411 - DNA, 19 bp, Artificial Sequence
  Description of Artificial Sequence: Synthetic oligonucleotide
tgactcgtacgagtcaggg

SEQ ID NO: 13412 - DNA, 19 bp, Artificial Sequence
  Description of Artificial Sequence: Synthetic oligonucleotide
cgactcgtacgagtcgtgg

SEQ ID NO: 13413 - DNA, 19 bp, Artificial Sequence
  Description of Artificial Sequence: Synthetic oligonucleotide
cgactcgtacgagtcggct

SEQ ID NO: 13414 - DNA, 19 bp, Artificial Sequence
  Description of Artificial Sequence: Synthetic oligonucleotide
cgactcgtacgagtcggca

SEQ ID NO: 13415 - DNA, 19 bp, Artificial Sequence
  Description of Artificial Sequence: Synthetic oligonucleotide
agactcgtacgagtctcgc

SEQ ID NO: 13416 - DNA, 19 bp, Artificial Sequence
  Description of Artificial Sequence: Synthetic oligonucleotide
tgactcgtacgagtcacgc

SEQ ID NO: 13417 - DNA, 19 bp, Artificial Sequence
  Description of Artificial Sequence: Synthetic oligonucleotide
ggactcgtacgagtcctgc

SEQ ID NO: 13418 - DNA, 19 bp, Artificial Sequence
  Description of Artificial Sequence: Synthetic oligonucleotide
ggactcgtacgagtccagc

SEQ ID NO: 13419 - DNA, 19 bp, Artificial Sequence
  Description of Artificial Sequence: Synthetic oligonucleotide
ggactcgtacgagtcctcg

SEQ ID NO: 13420 - DNA, 19 bp, Artificial Sequence
  Description of Artificial Sequence: Synthetic oligonucleotide
ggactcgtacgagtccacg

SEQ ID NO: 13421 - DNA, 19 bp, Artificial Sequence
  Description of Artificial Sequence: Synthetic oligonucleotide
cgactcgtacgagtcggtg

SEQ ID NO: 13422 - DNA, 19 bp, Artificial Sequence
  Description of Artificial Sequence: Synthetic oligonucleotide
cgactcgtacgagtcggag

SEQ ID NO: 13423 - DNA, 19 bp, Artificial Sequence
  Description of Artificial Sequence: Synthetic oligonucleotide
ggactcgtacgagtcccgc

SEQ ID NO: 13424 - DNA, 19 bp, Artificial Sequence
  Description of Artificial Sequence: Synthetic oligonucleotide
ggactcgtacgagtccctc

SEQ ID NO: 13425 - DNA, 19 bp, Artificial Sequence
  Description of Artificial Sequence: Synthetic oligonucleotide
ggactcgtacgagtcccac

SEQ ID NO: 13426 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcctaggagtcnnnn

SEQ ID NO: 13427 - DNA, 19 bp, Artificial Sequence
  Description of Artificial Sequence: Synthetic oligonucleotide
ggactcctaggagtccgcc

SEQ ID NO: 13428 - DNA, 19 bp, Artificial Sequence
  Description of Artificial Sequence: Synthetic oligonucleotide
ggactcctaggagtccgct

SEQ ID NO: 13429 - DNA, 19 bp, Artificial Sequence
  Description of Artificial Sequence: Synthetic oligonucleotide
ggactcctaggagtccgtc

SEQ ID NO: 13430 - DNA, 19 bp, Artificial Sequence
  Description of Artificial Sequence: Synthetic oligonucleotide
ggactcctaggagtcctcc

SEQ ID NO: 13431 - DNA, 19 bp, Artificial Sequence
  Description of Artificial Sequence: Synthetic oligonucleotide
agactcctaggagtctgcc

SEQ ID NO: 13432 - DNA, 19 bp, Artificial Sequence
  Description of Artificial Sequence: Synthetic oligonucleotide
ggactcctaggagtccgca

SEQ ID NO: 13433 - DNA, 19 bp, Artificial Sequence
  Description of Artificial Sequence: Synthetic oligonucleotide
ggactcctaggagtccgac

SEQ ID NO: 13434 - DNA, 19 bp, Artificial Sequence
  Description of Artificial Sequence: Synthetic oligonucleotide
ggactcctaggagtccacc

SEQ ID NO: 13435 - DNA, 19 bp, Artificial Sequence
  Description of Artificial Sequence: Synthetic oligonucleotide
tgactcctaggagtcagcc

SEQ ID NO: 13436 - DNA, 19 bp, Artificial Sequence
  Description of Artificial Sequence: Synthetic oligonucleotide
cgactcctaggagtcgggc

SEQ ID NO: 13437 - DNA, 19 bp, Artificial Sequence
  Description of Artificial Sequence: Synthetic oligonucleotide
cgactcctaggagtcgggt

SEQ ID NO: 13438 - DNA, 19 bp, Artificial Sequence
  Description of Artificial Sequence: Synthetic oligonucleotide
cgactcctaggagtcggtc

SEQ ID NO: 13439 - DNA, 19 bp, Artificial Sequence
  Description of Artificial Sequence: Synthetic oligonucleotide
cgactcctaggagtcgtgc

SEQ ID NO: 13440 - DNA, 19 bp, Artificial Sequence
  Description of Artificial Sequence: Synthetic oligonucleotide
agactcctaggagtctggc

SEQ ID NO: 13441 - DNA, 19 bp, Artificial Sequence
  Description of Artificial Sequence: Synthetic oligonucleotide
cgactcctaggagtcggga

SEQ ID NO: 13442 - DNA, 19 bp, Artificial Sequence
  Description of Artificial Sequence: Synthetic oligonucleotide
cgactcctaggagtcggac

SEQ ID NO: 13443 - DNA, 19 bp, Artificial Sequence
  Description of Artificial Sequence: Synthetic oligonucleotide
tgactcctaggagtcaggc

SEQ ID NO: 13444 - DNA, 19 bp, Artificial Sequence
  Description of Artificial Sequence: Synthetic oligonucleotide
cgactcctaggagtcgccc

SEQ ID NO: 13445 - DNA, 19 bp, Artificial Sequence
  Description of Artificial Sequence: Synthetic oligonucleotide
cgactcctaggagtcgcct

SEQ ID NO: 13446 - DNA, 19 bp, Artificial Sequence
  Description of Artificial Sequence: Synthetic oligonucleotide
cgactcctaggagtcgctc

SEQ ID NO: 13447 - DNA, 19 bp, Artificial Sequence
  Description of Artificial Sequence: Synthetic oligonucleotide
cgactcctaggagtcgtcc

SEQ ID NO: 13448 - DNA, 19 bp, Artificial Sequence
  Description of Artificial Sequence: Synthetic oligonucleotide
agactcctaggagtctccc

SEQ ID NO: 13449 - DNA, 19 bp, Artificial Sequence
  Description of Artificial Sequence: Synthetic oligonucleotide
cgactcctaggagtcgcca

SEQ ID NO: 13450 - DNA, 19 bp, Artificial Sequence
  Description of Artificial Sequence: Synthetic oligonucleotide
cgactcctaggagtcgcac

SEQ ID NO: 13451 - DNA, 19 bp, Artificial Sequence
  Description of Artificial Sequence: Synthetic oligonucleotide
tgactcctaggagtcaccc

SEQ ID NO: 13452 - DNA, 19 bp, Artificial Sequence
  Description of Artificial Sequence: Synthetic oligonucleotide
ggactcctaggagtcccgt

SEQ ID NO: 13453 - DNA, 19 bp, Artificial Sequence
  Description of Artificial Sequence: Synthetic oligonucleotide
ggactcctaggagtccctg

SEQ ID NO: 13454 - DNA, 19 bp, Artificial Sequence
  Description of Artificial Sequence: Synthetic oligonucleotide
ggactcctaggagtcctgg

SEQ ID NO: 13455 - DNA, 19 bp, Artificial Sequence
  Description of Artificial Sequence: Synthetic oligonucleotide
agactcctaggagtctcgg

SEQ ID NO: 13456 - DNA, 19 bp, Artificial Sequence
  Description of Artificial Sequence: Synthetic oligonucleotide
ggactcctaggagtcccga

SEQ ID NO: 13457 - DNA, 19 bp, Artificial Sequence
  Description of Artificial Sequence: Synthetic oligonucleotide
ggactcctaggagtcccag

SEQ ID NO: 13458 - DNA, 19 bp, Artificial Sequence
  Description of Artificial Sequence: Synthetic oligonucleotide
ggactcctaggagtccagg

SEQ ID NO: 13459 - DNA, 19 bp, Artificial Sequence
  Description of Artificial Sequence: Synthetic oligonucleotide
tgactcctaggagtcacgg

SEQ ID NO: 13460 - DNA, 19 bp, Artificial Sequence
  Description of Artificial Sequence: Synthetic oligonucleotide
cgactcctaggagtcgccg

SEQ ID NO: 13461 - DNA, 19 bp, Artificial Sequence
  Description of Artificial Sequence: Synthetic oligonucleotide
cgactcctaggagtcgctg

SEQ ID NO: 13462 - DNA, 19 bp, Artificial Sequence
  Description of Artificial Sequence: Synthetic oligonucleotide
cgactcctaggagtcgtcg

SEQ ID NO: 13463 - DNA, 19 bp, Artificial Sequence
  Description of Artificial Sequence: Synthetic oligonucleotide
agactcctaggagtctccg

SEQ ID NO: 13464 - DNA, 19 bp, Artificial Sequence
  Description of Artificial Sequence: Synthetic oligonucleotide
cgactcctaggagtcgcag

SEQ ID NO: 13465 - DNA, 19 bp, Artificial Sequence
  Description of Artificial Sequence: Synthetic oligonucleotide
tgactcctaggagtcaccg

SEQ ID NO: 13466 - DNA, 19 bp, Artificial Sequence
  Description of Artificial Sequence: Synthetic oligonucleotide
ggactcctaggagtccgtg

SEQ ID NO: 13467 - DNA, 19 bp, Artificial Sequence
  Description of Artificial Sequence: Synthetic oligonucleotide
agactcctaggagtctggg

SEQ ID NO: 13468 - DNA, 19 bp, Artificial Sequence
  Description of Artificial Sequence: Synthetic oligonucleotide
ggactcctaggagtccgag

SEQ ID NO: 13469 - DNA, 19 bp, Artificial Sequence
  Description of Artificial Sequence: Synthetic oligonucleotide
tgactcctaggagtcaggg

SEQ ID NO: 13470 - DNA, 19 bp, Artificial Sequence
  Description of Artificial Sequence: Synthetic oligonucleotide
cgactcctaggagtcgtgg

SEQ ID NO: 13471 - DNA, 19 bp, Artificial Sequence
  Description of Artificial Sequence: Synthetic oligonucleotide
cgactcctaggagtcggct

SEQ ID NO: 13472 - DNA, 19 bp, Artificial Sequence
  Description of Artificial Sequence: Synthetic oligonucleotide
cgactcctaggagtcggca

SEQ ID NO: 13473 - DNA, 19 bp, Artificial Sequence
  Description of Artificial Sequence: Synthetic oligonucleotide
agactcctaggagtctcgc

SEQ ID NO: 13474 - DNA, 19 bp, Artificial Sequence
  Description of Artificial Sequence: Synthetic oligonucleotide
tgactcctaggagtcacgc

SEQ ID NO: 13475 - DNA, 19 bp, Artificial Sequence
  Description of Artificial Sequence: Synthetic oligonucleotide
ggactcctaggagtcctgc

SEQ ID NO: 13476 - DNA, 19 bp, Artificial Sequence
  Description of Artificial Sequence: Synthetic oligonucleotide
ggactcctaggagtccagc

SEQ ID NO: 13477 - DNA, 19 bp, Artificial Sequence
  Description of Artificial Sequence: Synthetic oligonucleotide
ggactcctaggagtcctcg

SEQ ID NO: 13478 - DNA, 19 bp, Artificial Sequence
  Description of Artificial Sequence: Synthetic oligonucleotide
ggactcctaggagtccacg

SEQ ID NO: 13479 - DNA, 19 bp, Artificial Sequence
  Description of Artificial Sequence: Synthetic oligonucleotide
cgactcctaggagtcggtg

SEQ ID NO: 13480 - DNA, 19 bp, Artificial Sequence
  Description of Artificial Sequence: Synthetic oligonucleotide
cgactcctaggagtcggag

SEQ ID NO: 13481 - DNA, 19 bp, Artificial Sequence
  Description of Artificial Sequence: Synthetic oligonucleotide
ggactcctaggagtcccgc

SEQ ID NO: 13482 - DNA, 19 bp, Artificial Sequence
  Description of Artificial Sequence: Synthetic oligonucleotide
ggactcctaggagtccctc

SEQ ID NO: 13483 - DNA, 19 bp, Artificial Sequence
  Description of Artificial Sequence: Synthetic oligonucleotide
ggactcctaggagtcccac

SEQ ID NO: 13484 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactccatggagtcnnnn

SEQ ID NO: 13485 - DNA, 19 bp, Artificial Sequence
  Description of Artificial Sequence: Synthetic oligonucleotide
ggactccatggagtccgcc

SEQ ID NO: 13486 - DNA, 19 bp, Artificial Sequence
  Description of Artificial Sequence: Synthetic oligonucleotide
ggactccatggagtccgct

SEQ ID NO: 13487 - DNA, 19 bp, Artificial Sequence
  Description of Artificial Sequence: Synthetic oligonucleotide
ggactccatggagtccgtc

SEQ ID NO: 13488 - DNA, 19 bp, Artificial Sequence
  Description of Artificial Sequence: Synthetic oligonucleotide
ggactccatggagtcctcc

SEQ ID NO: 13489 - DNA, 19 bp, Artificial Sequence
  Description of Artificial Sequence: Synthetic oligonucleotide
agactccatggagtctgcc

SEQ ID NO: 13490 - DNA, 19 bp, Artificial Sequence
  Description of Artificial Sequence: Synthetic oligonucleotide
ggactccatggagtccgca

SEQ ID NO: 13491 - DNA, 19 bp, Artificial Sequence
  Description of Artificial Sequence: Synthetic oligonucleotide
ggactccatggagtccgac

SEQ ID NO: 13492 - DNA, 19 bp, Artificial Sequence
  Description of Artificial Sequence: Synthetic oligonucleotide
ggactccatggagtccacc

SEQ ID NO: 13493 - DNA, 19 bp, Artificial Sequence
  Description of Artificial Sequence: Synthetic oligonucleotide
tgactccatggagtcagcc

SEQ ID NO: 13494 - DNA, 19 bp, Artificial Sequence
  Description of Artificial Sequence: Synthetic oligonucleotide
cgactccatggagtcgggc

SEQ ID NO: 13495 - DNA, 19 bp, Artificial Sequence
  Description of Artificial Sequence: Synthetic oligonucleotide
cgactccatggagtcgggt

SEQ ID NO: 13496 - DNA, 19 bp, Artificial Sequence
  Description of Artificial Sequence: Synthetic oligonucleotide
cgactccatggagtcggtc

SEQ ID NO: 13497 - DNA, 19 bp, Artificial Sequence
  Description of Artificial Sequence: Synthetic oligonucleotide
cgactccatggagtcgtgc

SEQ ID NO: 13498 - DNA, 19 bp, Artificial Sequence
  Description of Artificial Sequence: Synthetic oligonucleotide
agactccatggagtctggc

SEQ ID NO: 13499 - DNA, 19 bp, Artificial Sequence
  Description of Artificial Sequence: Synthetic oligonucleotide
cgactccatggagtcggga

SEQ ID NO: 13500 - DNA, 19 bp, Artificial Sequence
  Description of Artificial Sequence: Synthetic oligonucleotide
cgactccatggagtcggac

SEQ ID NO: 13501 - DNA, 19 bp, Artificial Sequence
  Description of Artificial Sequence: Synthetic oligonucleotide
tgactccatggagtcaggc

SEQ ID NO: 13502 - DNA, 19 bp, Artificial Sequence
  Description of Artificial Sequence: Synthetic oligonucleotide
cgactccatggagtcgccc

SEQ ID NO: 13503 - DNA, 19 bp, Artificial Sequence
  Description of Artificial Sequence: Synthetic oligonucleotide
cgactccatggagtcgcct

SEQ ID NO: 13504 - DNA, 19 bp, Artificial Sequence
  Description of Artificial Sequence: Synthetic oligonucleotide
cgactccatggagtcgctc

SEQ ID NO: 13505 - DNA, 19 bp, Artificial Sequence
  Description of Artificial Sequence: Synthetic oligonucleotide
cgactccatggagtcgtcc

SEQ ID NO: 13506 - DNA, 19 bp, Artificial Sequence
  Description of Artificial Sequence: Synthetic oligonucleotide
agactccatggagtctccc

SEQ ID NO: 13507 - DNA, 19 bp, Artificial Sequence
  Description of Artificial Sequence: Synthetic oligonucleotide
cgactccatggagtcgcca

SEQ ID NO: 13508 - DNA, 19 bp, Artificial Sequence
  Description of Artificial Sequence: Synthetic oligonucleotide
cgactccatggagtcgcac

SEQ ID NO: 13509 - DNA, 19 bp, Artificial Sequence
  Description of Artificial Sequence: Synthetic oligonucleotide
tgactccatggagtcaccc

SEQ ID NO: 13510 - DNA, 19 bp, Artificial Sequence
  Description of Artificial Sequence: Synthetic oligonucleotide
ggactccatggagtcccgt

SEQ ID NO: 13511 - DNA, 19 bp, Artificial Sequence
  Description of Artificial Sequence: Synthetic oligonucleotide
ggactccatggagtccctg

SEQ ID NO: 13512 - DNA, 19 bp, Artificial Sequence
  Description of Artificial Sequence: Synthetic oligonucleotide
ggactccatggagtcctgg

SEQ ID NO: 13513 - DNA, 19 bp, Artificial Sequence
  Description of Artificial Sequence: Synthetic oligonucleotide
agactccatggagtctcgg

SEQ ID NO: 13514 - DNA, 19 bp, Artificial Sequence
  Description of Artificial Sequence: Synthetic oligonucleotide
ggactccatggagtcccga

SEQ ID NO: 13515 - DNA, 19 bp, Artificial Sequence
  Description of Artificial Sequence: Synthetic oligonucleotide
ggactccatggagtcccag

SEQ ID NO: 13516 - DNA, 19 bp, Artificial Sequence
  Description of Artificial Sequence: Synthetic oligonucleotide
ggactccatggagtccagg

SEQ ID NO: 13517 - DNA, 19 bp, Artificial Sequence
  Description of Artificial Sequence: Synthetic oligonucleotide
tgactccatggagtcacgg

SEQ ID NO: 13518 - DNA, 19 bp, Artificial Sequence
  Description of Artificial Sequence: Synthetic oligonucleotide
cgactccatggagtcgccg

SEQ ID NO: 13519 - DNA, 19 bp, Artificial Sequence
  Description of Artificial Sequence: Synthetic oligonucleotide
cgactccatggagtcgctg

SEQ ID NO: 13520 - DNA, 19 bp, Artificial Sequence
  Description of Artificial Sequence: Synthetic oligonucleotide
cgactccatggagtcgtcg

SEQ ID NO: 13521 - DNA, 19 bp, Artificial Sequence
  Description of Artificial Sequence: Synthetic oligonucleotide
agactccatggagtctccg

SEQ ID NO: 13522 - DNA, 19 bp, Artificial Sequence
  Description of Artificial Sequence: Synthetic oligonucleotide
cgactccatggagtcgcag

SEQ ID NO: 13523 - DNA, 19 bp, Artificial Sequence
  Description of Artificial Sequence: Synthetic oligonucleotide
tgactccatggagtcaccg

SEQ ID NO: 13524 - DNA, 19 bp, Artificial Sequence
  Description of Artificial Sequence: Synthetic oligonucleotide
ggactccatggagtccgtg

SEQ ID NO: 13525 - DNA, 19 bp, Artificial Sequence
  Description of Artificial Sequence: Synthetic oligonucleotide
agactccatggagtctggg

SEQ ID NO: 13526 - DNA, 19 bp, Artificial Sequence
  Description of Artificial Sequence: Synthetic oligonucleotide
ggactccatggagtccgag

SEQ ID NO: 13527 - DNA, 19 bp, Artificial Sequence
  Description of Artificial Sequence: Synthetic oligonucleotide
tgactccatggagtcaggg

SEQ ID NO: 13528 - DNA, 19 bp, Artificial Sequence
  Description of Artificial Sequence: Synthetic oligonucleotide
cgactccatggagtcgtgg

SEQ ID NO: 13529 - DNA, 19 bp, Artificial Sequence
  Description of Artificial Sequence: Synthetic oligonucleotide
cgactccatggagtcggct

SEQ ID NO: 13530 - DNA, 19 bp, Artificial Sequence
  Description of Artificial Sequence: Synthetic oligonucleotide
cgactccatggagtcggca

SEQ ID NO: 13531 - DNA, 19 bp, Artificial Sequence
  Description of Artificial Sequence: Synthetic oligonucleotide
agactccatggagtctcgc

SEQ ID NO: 13532 - DNA, 19 bp, Artificial Sequence
  Description of Artificial Sequence: Synthetic oligonucleotide
tgactccatggagtcacgc

SEQ ID NO: 13533 - DNA, 19 bp, Artificial Sequence
  Description of Artificial Sequence: Synthetic oligonucleotide
ggactccatggagtcctgc

SEQ ID NO: 13534 - DNA, 19 bp, Artificial Sequence
  Description of Artificial Sequence: Synthetic oligonucleotide
ggactccatggagtccagc

SEQ ID NO: 13535 - DNA, 19 bp, Artificial Sequence
  Description of Artificial Sequence: Synthetic oligonucleotide
ggactccatggagtcctcg

SEQ ID NO: 13536 - DNA, 19 bp, Artificial Sequence
  Description of Artificial Sequence: Synthetic oligonucleotide
ggactccatggagtccacg

SEQ ID NO: 13537 - DNA, 19 bp, Artificial Sequence
  Description of Artificial Sequence: Synthetic oligonucleotide
cgactccatggagtcggtg

SEQ ID NO: 13538 - DNA, 19 bp, Artificial Sequence
  Description of Artificial Sequence: Synthetic oligonucleotide
cgactccatggagtcggag

SEQ ID NO: 13539 - DNA, 19 bp, Artificial Sequence
  Description of Artificial Sequence: Synthetic oligonucleotide
ggactccatggagtcccgc

SEQ ID NO: 13540 - DNA, 19 bp, Artificial Sequence
  Description of Artificial Sequence: Synthetic oligonucleotide
ggactccatggagtccctc

SEQ ID NO: 13541 - DNA, 19 bp, Artificial Sequence
  Description of Artificial Sequence: Synthetic oligonucleotide
ggactccatggagtcccac

SEQ ID NO: 13542 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactctcgagagtcnnnn

SEQ ID NO: 13543 - DNA, 19 bp, Artificial Sequence
  Description of Artificial Sequence: Synthetic oligonucleotide
ggactctcgagagtccgcc

SEQ ID NO: 13544 - DNA, 19 bp, Artificial Sequence
  Description of Artificial Sequence: Synthetic oligonucleotide
ggactctcgagagtccgct

SEQ ID NO: 13545 - DNA, 19 bp, Artificial Sequence
  Description of Artificial Sequence: Synthetic oligonucleotide
ggactctcgagagtccgtc

SEQ ID NO: 13546 - DNA, 19 bp, Artificial Sequence
  Description of Artificial Sequence: Synthetic oligonucleotide
ggactctcgagagtcctcc

SEQ ID NO: 13547 - DNA, 19 bp, Artificial Sequence
  Description of Artificial Sequence: Synthetic oligonucleotide
agactctcgagagtctgcc

SEQ ID NO: 13548 - DNA, 19 bp, Artificial Sequence
  Description of Artificial Sequence: Synthetic oligonucleotide
ggactctcgagagtccgca

SEQ ID NO: 13549 - DNA, 19 bp, Artificial Sequence
  Description of Artificial Sequence: Synthetic oligonucleotide
ggactctcgagagtccgac

SEQ ID NO: 13550 - DNA, 19 bp, Artificial Sequence
  Description of Artificial Sequence: Synthetic oligonucleotide
ggactctcgagagtccacc

SEQ ID NO: 13551 - DNA, 19 bp, Artificial Sequence
  Description of Artificial Sequence: Synthetic oligonucleotide
tgactctcgagagtcagcc

SEQ ID NO: 13552 - DNA, 19 bp, Artificial Sequence
  Description of Artificial Sequence: Synthetic oligonucleotide
cgactctcgagagtcgggc

SEQ ID NO: 13553 - DNA, 19 bp, Artificial Sequence
  Description of Artificial Sequence: Synthetic oligonucleotide
cgactctcgagagtcgggt

SEQ ID NO: 13554 - DNA, 19 bp, Artificial Sequence
  Description of Artificial Sequence: Synthetic oligonucleotide
cgactctcgagagtcggtc

SEQ ID NO: 13555 - DNA, 19 bp, Artificial Sequence
  Description of Artificial Sequence: Synthetic oligonucleotide
cgactctcgagagtcgtgc

SEQ ID NO: 13556 - DNA, 19 bp, Artificial Sequence
  Description of Artificial Sequence: Synthetic oligonucleotide
agactctcgagagtctggc

SEQ ID NO: 13557 - DNA, 19 bp, Artificial Sequence
  Description of Artificial Sequence: Synthetic oligonucleotide
cgactctcgagagtcggga

SEQ ID NO: 13558 - DNA, 19 bp, Artificial Sequence
  Description of Artificial Sequence: Synthetic oligonucleotide
cgactctcgagagtcggac

SEQ ID NO: 13559 - DNA, 19 bp, Artificial Sequence
  Description of Artificial Sequence: Synthetic oligonucleotide
tgactctcgagagtcaggc

SEQ ID NO: 13560 - DNA, 19 bp, Artificial Sequence
  Description of Artificial Sequence: Synthetic oligonucleotide
cgactctcgagagtcgccc

SEQ ID NO: 13561 - DNA, 19 bp, Artificial Sequence
  Description of Artificial Sequence: Synthetic oligonucleotide
cgactctcgagagtcgcct

SEQ ID NO: 13562 - DNA, 19 bp, Artificial Sequence
  Description of Artificial Sequence: Synthetic oligonucleotide
cgactctcgagagtcgctc

SEQ ID NO: 13563 - DNA, 19 bp, Artificial Sequence
  Description of Artificial Sequence: Synthetic oligonucleotide
cgactctcgagagtcgtcc

SEQ ID NO: 13564 - DNA, 19 bp, Artificial Sequence
  Description of Artificial Sequence: Synthetic oligonucleotide
agactctcgagagtctccc

SEQ ID NO: 13565 - DNA, 19 bp, Artificial Sequence
  Description of Artificial Sequence: Synthetic oligonucleotide
cgactctcgagagtcgcca

SEQ ID NO: 13566 - DNA, 19 bp, Artificial Sequence
  Description of Artificial Sequence: Synthetic oligonucleotide
cgactctcgagagtcgcac

SEQ ID NO: 13567 - DNA, 19 bp, Artificial Sequence
  Description of Artificial Sequence: Synthetic oligonucleotide
tgactctcgagagtcaccc

SEQ ID NO: 13568 - DNA, 19 bp, Artificial Sequence
  Description of Artificial Sequence: Synthetic oligonucleotide
ggactctcgagagtcccgt

SEQ ID NO: 13569 - DNA, 19 bp, Artificial Sequence
  Description of Artificial Sequence: Synthetic oligonucleotide
ggactctcgagagtccctg

SEQ ID NO: 13570 - DNA, 19 bp, Artificial Sequence
  Description of Artificial Sequence: Synthetic oligonucleotide
ggactctcgagagtcctgg

SEQ ID NO: 13571 - DNA, 19 bp, Artificial Sequence
  Description of Artificial Sequence: Synthetic oligonucleotide
agactctcgagagtctcgg

SEQ ID NO: 13572 - DNA, 19 bp, Artificial Sequence
  Description of Artificial Sequence: Synthetic oligonucleotide
ggactctcgagagtcccga

SEQ ID NO: 13573 - DNA, 19 bp, Artificial Sequence
  Description of Artificial Sequence: Synthetic oligonucleotide
ggactctcgagagtcccag

SEQ ID NO: 13574 - DNA, 19 bp, Artificial Sequence
  Description of Artificial Sequence: Synthetic oligonucleotide
ggactctcgagagtccagg

SEQ ID NO: 13575 - DNA, 19 bp, Artificial Sequence
  Description of Artificial Sequence: Synthetic oligonucleotide
tgactctcgagagtcacgg

SEQ ID NO: 13576 - DNA, 19 bp, Artificial Sequence
  Description of Artificial Sequence: Synthetic oligonucleotide
cgactctcgagagtcgccg

SEQ ID NO: 13577 - DNA, 19 bp, Artificial Sequence
  Description of Artificial Sequence: Synthetic oligonucleotide
cgactctcgagagtcgctg

SEQ ID NO: 13578 - DNA, 19 bp, Artificial Sequence
  Description of Artificial Sequence: Synthetic oligonucleotide
cgactctcgagagtcgtcg

SEQ ID NO: 13579 - DNA, 19 bp, Artificial Sequence
  Description of Artificial Sequence: Synthetic oligonucleotide
agactctcgagagtctccg

SEQ ID NO: 13580 - DNA, 19 bp, Artificial Sequence
  Description of Artificial Sequence: Synthetic oligonucleotide
cgactctcgagagtcgcag

SEQ ID NO: 13581 - DNA, 19 bp, Artificial Sequence
  Description of Artificial Sequence: Synthetic oligonucleotide
tgactctcgagagtcaccg

SEQ ID NO: 13582 - DNA, 19 bp, Artificial Sequence
  Description of Artificial Sequence: Synthetic oligonucleotide
ggactctcgagagtccgtg

SEQ ID NO: 13583 - DNA, 19 bp, Artificial Sequence
  Description of Artificial Sequence: Synthetic oligonucleotide
agactctcgagagtctggg

SEQ ID NO: 13584 - DNA, 19 bp, Artificial Sequence
  Description of Artificial Sequence: Synthetic oligonucleotide
ggactctcgagagtccgag

SEQ ID NO: 13585 - DNA, 19 bp, Artificial Sequence
  Description of Artificial Sequence: Synthetic oligonucleotide
tgactctcgagagtcaggg

SEQ ID NO: 13586 - DNA, 19 bp, Artificial Sequence
  Description of Artificial Sequence: Synthetic oligonucleotide
cgactctcgagagtcgtgg

SEQ ID NO: 13587 - DNA, 19 bp, Artificial Sequence
  Description of Artificial Sequence: Synthetic oligonucleotide
cgactctcgagagtcggct

SEQ ID NO: 13588 - DNA, 19 bp, Artificial Sequence
  Description of Artificial Sequence: Synthetic oligonucleotide
cgactctcgagagtcggca

SEQ ID NO: 13589 - DNA, 19 bp, Artificial Sequence
  Description of Artificial Sequence: Synthetic oligonucleotide
agactctcgagagtctcgc

SEQ ID NO: 13590 - DNA, 19 bp, Artificial Sequence
  Description of Artificial Sequence: Synthetic oligonucleotide
tgactctcgagagtcacgc

SEQ ID NO: 13591 - DNA, 19 bp, Artificial Sequence
  Description of Artificial Sequence: Synthetic oligonucleotide
ggactctcgagagtcctgc

SEQ ID NO: 13592 - DNA, 19 bp, Artificial Sequence
  Description of Artificial Sequence: Synthetic oligonucleotide
ggactctcgagagtccagc

SEQ ID NO: 13593 - DNA, 19 bp, Artificial Sequence
  Description of Artificial Sequence: Synthetic oligonucleotide
ggactctcgagagtcctcg

SEQ ID NO: 13594 - DNA, 19 bp, Artificial Sequence
  Description of Artificial Sequence: Synthetic oligonucleotide
ggactctcgagagtccacg

SEQ ID NO: 13595 - DNA, 19 bp, Artificial Sequence
  Description of Artificial Sequence: Synthetic oligonucleotide
cgactctcgagagtcggtg

SEQ ID NO: 13596 - DNA, 19 bp, Artificial Sequence
  Description of Artificial Sequence: Synthetic oligonucleotide
cgactctcgagagtcggag

SEQ ID NO: 13597 - DNA, 19 bp, Artificial Sequence
  Description of Artificial Sequence: Synthetic oligonucleotide
ggactctcgagagtcccgc

SEQ ID NO: 13598 - DNA, 19 bp, Artificial Sequence
  Description of Artificial Sequence: Synthetic oligonucleotide
ggactctcgagagtccctc

SEQ ID NO: 13599 - DNA, 19 bp, Artificial Sequence
  Description of Artificial Sequence: Synthetic oligonucleotide
ggactctcgagagtcccac

SEQ ID NO: 13600 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcagctgagtcnnnn

SEQ ID NO: 13601 - DNA, 19 bp, Artificial Sequence
  Description of Artificial Sequence: Synthetic oligonucleotide
ggactcagctgagtccgcc

SEQ ID NO: 13602 - DNA, 19 bp, Artificial Sequence
  Description of Artificial Sequence: Synthetic oligonucleotide
ggactcagctgagtccgct

SEQ ID NO: 13603 - DNA, 19 bp, Artificial Sequence
  Description of Artificial Sequence: Synthetic oligonucleotide
ggactcagctgagtccgtc

SEQ ID NO: 13604 - DNA, 19 bp, Artificial Sequence
  Description of Artificial Sequence: Synthetic oligonucleotide
ggactcagctgagtcctcc

SEQ ID NO: 13605 - DNA, 19 bp, Artificial Sequence
  Description of Artificial Sequence: Synthetic oligonucleotide
agactcagctgagtctgcc

SEQ ID NO: 13606 - DNA, 19 bp, Artificial Sequence
  Description of Artificial Sequence: Synthetic oligonucleotide
ggactcagctgagtccgca

SEQ ID NO: 13607 - DNA, 19 bp, Artificial Sequence
  Description of Artificial Sequence: Synthetic oligonucleotide
ggactcagctgagtccgac

SEQ ID NO: 13608 - DNA, 19 bp, Artificial Sequence
  Description of Artificial Sequence: Synthetic oligonucleotide
ggactcagctgagtccacc

SEQ ID NO: 13609 - DNA, 19 bp, Artificial Sequence
  Description of Artificial Sequence: Synthetic oligonucleotide
tgactcagctgagtcagcc

SEQ ID NO: 13610 - DNA, 19 bp, Artificial Sequence
  Description of Artificial Sequence: Synthetic oligonucleotide
cgactcagctgagtcgggc

SEQ ID NO: 13611 - DNA, 19 bp, Artificial Sequence
  Description of Artificial Sequence: Synthetic oligonucleotide
cgactcagctgagtcgggt

SEQ ID NO: 13612 - DNA, 19 bp, Artificial Sequence
  Description of Artificial Sequence: Synthetic oligonucleotide
cgactcagctgagtcggtc

SEQ ID NO: 13613 - DNA, 19 bp, Artificial Sequence
  Description of Artificial Sequence: Synthetic oligonucleotide
cgactcagctgagtcgtgc

SEQ ID NO: 13614 - DNA, 19 bp, Artificial Sequence
  Description of Artificial Sequence: Synthetic oligonucleotide
agactcagctgagtctggc

SEQ ID NO: 13615 - DNA, 19 bp, Artificial Sequence
  Description of Artificial Sequence: Synthetic oligonucleotide
cgactcagctgagtcggga

SEQ ID NO: 13616 - DNA, 19 bp, Artificial Sequence
  Description of Artificial Sequence: Synthetic oligonucleotide
cgactcagctgagtcggac

SEQ ID NO: 13617 - DNA, 19 bp, Artificial Sequence
  Description of Artificial Sequence: Synthetic oligonucleotide
tgactcagctgagtcaggc

SEQ ID NO: 13618 - DNA, 19 bp, Artificial Sequence
  Description of Artificial Sequence: Synthetic oligonucleotide
cgactcagctgagtcgccc

SEQ ID NO: 13619 - DNA, 19 bp, Artificial Sequence
  Description of Artificial Sequence: Synthetic oligonucleotide
cgactcagctgagtcgcct

SEQ ID NO: 13620 - DNA, 19 bp, Artificial Sequence
  Description of Artificial Sequence: Synthetic oligonucleotide
cgactcagctgagtcgctc

SEQ ID NO: 13621 - DNA, 19 bp, Artificial Sequence
  Description of Artificial Sequence: Synthetic oligonucleotide
cgactcagctgagtcgtcc

SEQ ID NO: 13622 - DNA, 19 bp, Artificial Sequence
  Description of Artificial Sequence: Synthetic oligonucleotide
agactcagctgagtctccc

SEQ ID NO: 13623 - DNA, 19 bp, Artificial Sequence
  Description of Artificial Sequence: Synthetic oligonucleotide
cgactcagctgagtcgcca

SEQ ID NO: 13624 - DNA, 19 bp, Artificial Sequence
  Description of Artificial Sequence: Synthetic oligonucleotide
cgactcagctgagtcgcac

SEQ ID NO: 13625 - DNA, 19 bp, Artificial Sequence
  Description of Artificial Sequence: Synthetic oligonucleotide
tgactcagctgagtcaccc

SEQ ID NO: 13626 - DNA, 19 bp, Artificial Sequence
  Description of Artificial Sequence: Synthetic oligonucleotide
ggactcagctgagtcccgt

SEQ ID NO: 13627 - DNA, 19 bp, Artificial Sequence
  Description of Artificial Sequence: Synthetic oligonucleotide
ggactcagctgagtccctg

SEQ ID NO: 13628 - DNA, 19 bp, Artificial Sequence
  Description of Artificial Sequence: Synthetic oligonucleotide
ggactcagctgagtcctgg

SEQ ID NO: 13629 - DNA, 19 bp, Artificial Sequence
  Description of Artificial Sequence: Synthetic oligonucleotide
agactcagctgagtctcgg

SEQ ID NO: 13630 - DNA, 19 bp, Artificial Sequence
  Description of Artificial Sequence: Synthetic oligonucleotide
ggactcagctgagtcccga

SEQ ID NO: 13631 - DNA, 19 bp, Artificial Sequence
  Description of Artificial Sequence: Synthetic oligonucleotide
ggactcagctgagtcccag

SEQ ID NO: 13632 - DNA, 19 bp, Artificial Sequence
  Description of Artificial Sequence: Synthetic oligonucleotide
ggactcagctgagtccagg

SEQ ID NO: 13633 - DNA, 19 bp, Artificial Sequence
  Description of Artificial Sequence: Synthetic oligonucleotide
tgactcagctgagtcacgg

SEQ ID NO: 13634 - DNA, 19 bp, Artificial Sequence
  Description of Artificial Sequence: Synthetic oligonucleotide
cgactcagctgagtcgccg

SEQ ID NO: 13635 - DNA, 19 bp, Artificial Sequence
  Description of Artificial Sequence: Synthetic oligonucleotide
cgactcagctgagtcgctg

SEQ ID NO: 13636 - DNA, 19 bp, Artificial Sequence
  Description of Artificial Sequence: Synthetic oligonucleotide
cgactcagctgagtcgtcg

SEQ ID NO: 13637 - DNA, 19 bp, Artificial Sequence
  Description of Artificial Sequence: Synthetic oligonucleotide
agactcagctgagtctccg

SEQ ID NO: 13638 - DNA, 19 bp, Artificial Sequence
  Description of Artificial Sequence: Synthetic oligonucleotide
cgactcagctgagtcgcag

SEQ ID NO: 13639 - DNA, 19 bp, Artificial Sequence
  Description of Artificial Sequence: Synthetic oligonucleotide
tgactcagctgagtcaccg

SEQ ID NO: 13640 - DNA, 19 bp, Artificial Sequence
  Description of Artificial Sequence: Synthetic oligonucleotide
ggactcagctgagtccgtg

SEQ ID NO: 13641 - DNA, 19 bp, Artificial Sequence
  Description of Artificial Sequence: Synthetic oligonucleotide
agactcagctgagtctggg

SEQ ID NO: 13642 - DNA, 19 bp, Artificial Sequence
  Description of Artificial Sequence: Synthetic oligonucleotide
ggactcagctgagtccgag

SEQ ID NO: 13643 - DNA, 19 bp, Artificial Sequence
  Description of Artificial Sequence: Synthetic oligonucleotide
tgactcagctgagtcaggg

SEQ ID NO: 13644 - DNA, 19 bp, Artificial Sequence
  Description of Artificial Sequence: Synthetic oligonucleotide
cgactcagctgagtcgtgg

SEQ ID NO: 13645 - DNA, 19 bp, Artificial Sequence
  Description of Artificial Sequence: Synthetic oligonucleotide
cgactcagctgagtcggct

SEQ ID NO: 13646 - DNA, 19 bp, Artificial Sequence
  Description of Artificial Sequence: Synthetic oligonucleotide
cgactcagctgagtcggca

SEQ ID NO: 13647 - DNA, 19 bp, Artificial Sequence
  Description of Artificial Sequence: Synthetic oligonucleotide
agactcagctgagtctcgc

SEQ ID NO: 13648 - DNA, 19 bp, Artificial Sequence
  Description of Artificial Sequence: Synthetic oligonucleotide
tgactcagctgagtcacgc

SEQ ID NO: 13649 - DNA, 19 bp, Artificial Sequence
  Description of Artificial Sequence: Synthetic oligonucleotide
ggactcagctgagtcctgc

SEQ ID NO: 13650 - DNA, 19 bp, Artificial Sequence
  Description of Artificial Sequence: Synthetic oligonucleotide
ggactcagctgagtccagc

SEQ ID NO: 13651 - DNA, 19 bp, Artificial Sequence
  Description of Artificial Sequence: Synthetic oligonucleotide
ggactcagctgagtcctcg

SEQ ID NO: 13652 - DNA, 19 bp, Artificial Sequence
  Description of Artificial Sequence: Synthetic oligonucleotide
ggactcagctgagtccacg

SEQ ID NO: 13653 - DNA, 19 bp, Artificial Sequence
  Description of Artificial Sequence: Synthetic oligonucleotide
cgactcagctgagtcggtg

SEQ ID NO: 13654 - DNA, 19 bp, Artificial Sequence
  Description of Artificial Sequence: Synthetic oligonucleotide
cgactcagctgagtcggag

SEQ ID NO: 13655 - DNA, 19 bp, Artificial Sequence
  Description of Artificial Sequence: Synthetic oligonucleotide
ggactcagctgagtcccgc

SEQ ID NO: 13656 - DNA, 19 bp, Artificial Sequence
  Description of Artificial Sequence: Synthetic oligonucleotide
ggactcagctgagtccctc

SEQ ID NO: 13657 - DNA, 19 bp, Artificial Sequence
  Description of Artificial Sequence: Synthetic oligonucleotide
ggactcagctgagtcccac

SEQ ID NO: 13658 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcaattgagtcnnnn

SEQ ID NO: 13659 - DNA, 19 bp, Artificial Sequence
  Description of Artificial Sequence: Synthetic oligonucleotide
ggactcaattgagtccgcc

SEQ ID NO: 13660 - DNA, 19 bp, Artificial Sequence
  Description of Artificial Sequence: Synthetic oligonucleotide
ggactcaattgagtccgct

SEQ ID NO: 13661 - DNA, 19 bp, Artificial Sequence
  Description of Artificial Sequence: Synthetic oligonucleotide
ggactcaattgagtccgtc

SEQ ID NO: 13662 - DNA, 19 bp, Artificial Sequence
  Description of Artificial Sequence: Synthetic oligonucleotide
ggactcaattgagtcctcc

SEQ ID NO: 13663 - DNA, 19 bp, Artificial Sequence
  Description of Artificial Sequence: Synthetic oligonucleotide
agactcaattgagtctgcc

SEQ ID NO: 13664 - DNA, 19 bp, Artificial Sequence
  Description of Artificial Sequence: Synthetic oligonucleotide
ggactcaattgagtccgca

SEQ ID NO: 13665 - DNA, 19 bp, Artificial Sequence
  Description of Artificial Sequence: Synthetic oligonucleotide
ggactcaattgagtccgac

SEQ ID NO: 13666 - DNA, 19 bp, Artificial Sequence
  Description of Artificial Sequence: Synthetic oligonucleotide
ggactcaattgagtccacc

SEQ ID NO: 13667 - DNA, 19 bp, Artificial Sequence
  Description of Artificial Sequence: Synthetic oligonucleotide
tgactcaattgagtcagcc

SEQ ID NO: 13668 - DNA, 19 bp, Artificial Sequence
  Description of Artificial Sequence: Synthetic oligonucleotide
cgactcaattgagtcgggc

SEQ ID NO: 13669 - DNA, 19 bp, Artificial Sequence
  Description of Artificial Sequence: Synthetic oligonucleotide
cgactcaattgagtcgggt

SEQ ID NO: 13670 - DNA, 19 bp, Artificial Sequence
  Description of Artificial Sequence: Synthetic oligonucleotide
cgactcaattgagtcggtc

SEQ ID NO: 13671 - DNA, 19 bp, Artificial Sequence
  Description of Artificial Sequence: Synthetic oligonucleotide
cgactcaattgagtcgtgc

SEQ ID NO: 13672 - DNA, 19 bp, Artificial Sequence
  Description of Artificial Sequence: Synthetic oligonucleotide
agactcaattgagtctggc

SEQ ID NO: 13673 - DNA, 19 bp, Artificial Sequence
  Description of Artificial Sequence: Synthetic oligonucleotide
cgactcaattgagtcggga

SEQ ID NO: 13674 - DNA, 19 bp, Artificial Sequence
  Description of Artificial Sequence: Synthetic oligonucleotide
cgactcaattgagtcggac

SEQ ID NO: 13675 - DNA, 19 bp, Artificial Sequence
  Description of Artificial Sequence: Synthetic oligonucleotide
tgactcaattgagtcaggc

SEQ ID NO: 13676 - DNA, 19 bp, Artificial Sequence
  Description of Artificial Sequence: Synthetic oligonucleotide
cgactcaattgagtcgccc

SEQ ID NO: 13677 - DNA, 19 bp, Artificial Sequence
  Description of Artificial Sequence: Synthetic oligonucleotide
cgactcaattgagtcgcct

SEQ ID NO: 13678 - DNA, 19 bp, Artificial Sequence
  Description of Artificial Sequence: Synthetic oligonucleotide
cgactcaattgagtcgctc

SEQ ID NO: 13679 - DNA, 19 bp, Artificial Sequence
  Description of Artificial Sequence: Synthetic oligonucleotide
cgactcaattgagtcgtcc

SEQ ID NO: 13680 - DNA, 19 bp, Artificial Sequence
  Description of Artificial Sequence: Synthetic oligonucleotide
agactcaattgagtctccc

SEQ ID NO: 13681 - DNA, 19 bp, Artificial Sequence
  Description of Artificial Sequence: Synthetic oligonucleotide
cgactcaattgagtcgcca

SEQ ID NO: 13682 - DNA, 19 bp, Artificial Sequence
  Description of Artificial Sequence: Synthetic oligonucleotide
cgactcaattgagtcgcac

SEQ ID NO: 13683 - DNA, 19 bp, Artificial Sequence
  Description of Artificial Sequence: Synthetic oligonucleotide
tgactcaattgagtcaccc

SEQ ID NO: 13684 - DNA, 19 bp, Artificial Sequence
  Description of Artificial Sequence: Synthetic oligonucleotide
ggactcaattgagtcccgt

SEQ ID NO: 13685 - DNA, 19 bp, Artificial Sequence
  Description of Artificial Sequence: Synthetic oligonucleotide
ggactcaattgagtccctg

SEQ ID NO: 13686 - DNA, 19 bp, Artificial Sequence
  Description of Artificial Sequence: Synthetic oligonucleotide
ggactcaattgagtcctgg

SEQ ID NO: 13687 - DNA, 19 bp, Artificial Sequence
  Description of Artificial Sequence: Synthetic oligonucleotide
agactcaattgagtctcgg

SEQ ID NO: 13688 - DNA, 19 bp, Artificial Sequence
  Description of Artificial Sequence: Synthetic oligonucleotide
ggactcaattgagtcccga

SEQ ID NO: 13689 - DNA, 19 bp, Artificial Sequence
  Description of Artificial Sequence: Synthetic oligonucleotide
ggactcaattgagtcccag

SEQ ID NO: 13690 - DNA, 19 bp, Artificial Sequence
  Description of Artificial Sequence: Synthetic oligonucleotide
ggactcaattgagtccagg

SEQ ID NO: 13691 - DNA, 19 bp, Artificial Sequence
  Description of Artificial Sequence: Synthetic oligonucleotide
tgactcaattgagtcacgg

SEQ ID NO: 13692 - DNA, 19 bp, Artificial Sequence
  Description of Artificial Sequence: Synthetic oligonucleotide
cgactcaattgagtcgccg

SEQ ID NO: 13693 - DNA, 19 bp, Artificial Sequence
  Description of Artificial Sequence: Synthetic oligonucleotide
cgactcaattgagtcgctg

SEQ ID NO: 13694 - DNA, 19 bp, Artificial Sequence
  Description of Artificial Sequence: Synthetic oligonucleotide
cgactcaattgagtcgtcg

SEQ ID NO: 13695 - DNA, 19 bp, Artificial Sequence
  Description of Artificial Sequence: Synthetic oligonucleotide
agactcaattgagtctccg

SEQ ID NO: 13696 - DNA, 19 bp, Artificial Sequence
  Description of Artificial Sequence: Synthetic oligonucleotide
cgactcaattgagtcgcag

SEQ ID NO: 13697 - DNA, 19 bp, Artificial Sequence
  Description of Artificial Sequence: Synthetic oligonucleotide
tgactcaattgagtcaccg

SEQ ID NO: 13698 - DNA, 19 bp, Artificial Sequence
  Description of Artificial Sequence: Synthetic oligonucleotide
ggactcaattgagtccgtg

SEQ ID NO: 13699 - DNA, 19 bp, Artificial Sequence
  Description of Artificial Sequence: Synthetic oligonucleotide
agactcaattgagtctggg

SEQ ID NO: 13700 - DNA, 19 bp, Artificial Sequence
  Description of Artificial Sequence: Synthetic oligonucleotide
ggactcaattgagtccgag

SEQ ID NO: 13701 - DNA, 19 bp, Artificial Sequence
  Description of Artificial Sequence: Synthetic oligonucleotide
tgactcaattgagtcaggg

SEQ ID NO: 13702 - DNA, 19 bp, Artificial Sequence
  Description of Artificial Sequence: Synthetic oligonucleotide
cgactcaattgagtcgtgg

SEQ ID NO: 13703 - DNA, 19 bp, Artificial Sequence
  Description of Artificial Sequence: Synthetic oligonucleotide
cgactcaattgagtcggct

SEQ ID NO: 13704 - DNA, 19 bp, Artificial Sequence
  Description of Artificial Sequence: Synthetic oligonucleotide
cgactcaattgagtcggca

SEQ ID NO: 13705 - DNA, 19 bp, Artificial Sequence
  Description of Artificial Sequence: Synthetic oligonucleotide
agactcaattgagtctcgc

SEQ ID NO: 13706 - DNA, 19 bp, Artificial Sequence
  Description of Artificial Sequence: Synthetic oligonucleotide
tgactcaattgagtcacgc

SEQ ID NO: 13707 - DNA, 19 bp, Artificial Sequence
  Description of Artificial Sequence: Synthetic oligonucleotide
ggactcaattgagtcctgc

SEQ ID NO: 13708 - DNA, 19 bp, Artificial Sequence
  Description of Artificial Sequence: Synthetic oligonucleotide
ggactcaattgagtccagc

SEQ ID NO: 13709 - DNA, 19 bp, Artificial Sequence
  Description of Artificial Sequence: Synthetic oligonucleotide
ggactcaattgagtcctcg

SEQ ID NO: 13710 - DNA, 19 bp, Artificial Sequence
  Description of Artificial Sequence: Synthetic oligonucleotide
ggactcaattgagtccacg

SEQ ID NO: 13711 - DNA, 19 bp, Artificial Sequence
  Description of Artificial Sequence: Synthetic oligonucleotide
cgactcaattgagtcggtg

SEQ ID NO: 13712 - DNA, 19 bp, Artificial Sequence
  Description of Artificial Sequence: Synthetic oligonucleotide
cgactcaattgagtcggag

SEQ ID NO: 13713 - DNA, 19 bp, Artificial Sequence
  Description of Artificial Sequence: Synthetic oligonucleotide
ggactcaattgagtcccgc

SEQ ID NO: 13714 - DNA, 19 bp, Artificial Sequence
  Description of Artificial Sequence: Synthetic oligonucleotide
ggactcaattgagtccctc

SEQ ID NO: 13715 - DNA, 19 bp, Artificial Sequence
  Description of Artificial Sequence: Synthetic oligonucleotide
ggactcaattgagtcccac

SEQ ID NO: 13716 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactctatagagtcnnnn

SEQ ID NO: 13717 - DNA, 19 bp, Artificial Sequence
  Description of Artificial Sequence: Synthetic oligonucleotide
ggactctatagagtccgcc

SEQ ID NO: 13718 - DNA, 19 bp, Artificial Sequence
  Description of Artificial Sequence: Synthetic oligonucleotide
ggactctatagagtccgct

SEQ ID NO: 13719 - DNA, 19 bp, Artificial Sequence
  Description of Artificial Sequence: Synthetic oligonucleotide
ggactctatagagtccgtc

SEQ ID NO: 13720 - DNA, 19 bp, Artificial Sequence
  Description of Artificial Sequence: Synthetic oligonucleotide
ggactctatagagtcctcc

SEQ ID NO: 13721 - DNA, 19 bp, Artificial Sequence
  Description of Artificial Sequence: Synthetic oligonucleotide
agactctatagagtctgcc

SEQ ID NO: 13722 - DNA, 19 bp, Artificial Sequence
  Description of Artificial Sequence: Synthetic oligonucleotide
ggactctatagagtccgca

SEQ ID NO: 13723 - DNA, 19 bp, Artificial Sequence
  Description of Artificial Sequence: Synthetic oligonucleotide
ggactctatagagtccgac

SEQ ID NO: 13724 - DNA, 19 bp, Artificial Sequence
  Description of Artificial Sequence: Synthetic oligonucleotide
ggactctatagagtccacc

SEQ ID NO: 13725 - DNA, 19 bp, Artificial Sequence
  Description of Artificial Sequence: Synthetic oligonucleotide
tgactctatagagtcagcc

SEQ ID NO: 13726 - DNA, 19 bp, Artificial Sequence
  Description of Artificial Sequence: Synthetic oligonucleotide
cgactctatagagtcgggc

SEQ ID NO: 13727 - DNA, 19 bp, Artificial Sequence
  Description of Artificial Sequence: Synthetic oligonucleotide
cgactctatagagtcgggt

SEQ ID NO: 13728 - DNA, 19 bp, Artificial Sequence
  Description of Artificial Sequence: Synthetic oligonucleotide
cgactctatagagtcggtc

SEQ ID NO: 13729 - DNA, 19 bp, Artificial Sequence
  Description of Artificial Sequence: Synthetic oligonucleotide
cgactctatagagtcgtgc

SEQ ID NO: 13730 - DNA, 19 bp, Artificial Sequence
  Description of Artificial Sequence: Synthetic oligonucleotide
agactctatagagtctggc

SEQ ID NO: 13731 - DNA, 19 bp, Artificial Sequence
  Description of Artificial Sequence: Synthetic oligonucleotide
cgactctatagagtcggga

SEQ ID NO: 13732 - DNA, 19 bp, Artificial Sequence
  Description of Artificial Sequence: Synthetic oligonucleotide
cgactctatagagtcggac

SEQ ID NO: 13733 - DNA, 19 bp, Artificial Sequence
  Description of Artificial Sequence: Synthetic oligonucleotide
tgactctatagagtcaggc

SEQ ID NO: 13734 - DNA, 19 bp, Artificial Sequence
  Description of Artificial Sequence: Synthetic oligonucleotide
cgactctatagagtcgccc

SEQ ID NO: 13735 - DNA, 19 bp, Artificial Sequence
  Description of Artificial Sequence: Synthetic oligonucleotide
cgactctatagagtcgcct

SEQ ID NO: 13736 - DNA, 19 bp, Artificial Sequence
  Description of Artificial Sequence: Synthetic oligonucleotide
cgactctatagagtcgctc

SEQ ID NO: 13737 - DNA, 19 bp, Artificial Sequence
  Description of Artificial Sequence: Synthetic oligonucleotide
cgactctatagagtcgtcc

SEQ ID NO: 13738 - DNA, 19 bp, Artificial Sequence
  Description of Artificial Sequence: Synthetic oligonucleotide
agactctatagagtctccc

SEQ ID NO: 13739 - DNA, 19 bp, Artificial Sequence
  Description of Artificial Sequence: Synthetic oligonucleotide
cgactctatagagtcgcca

SEQ ID NO: 13740 - DNA, 19 bp, Artificial Sequence
  Description of Artificial Sequence: Synthetic oligonucleotide
cgactctatagagtcgcac

SEQ ID NO: 13741 - DNA, 19 bp, Artificial Sequence
  Description of Artificial Sequence: Synthetic oligonucleotide
tgactctatagagtcaccc

SEQ ID NO: 13742 - DNA, 19 bp, Artificial Sequence
  Description of Artificial Sequence: Synthetic oligonucleotide
ggactctatagagtcccgt

SEQ ID NO: 13743 - DNA, 19 bp, Artificial Sequence
  Description of Artificial Sequence: Synthetic oligonucleotide
ggactctatagagtccctg

SEQ ID NO: 13744 - DNA, 19 bp, Artificial Sequence
  Description of Artificial Sequence: Synthetic oligonucleotide
ggactctatagagtcctgg

SEQ ID NO: 13745 - DNA, 19 bp, Artificial Sequence
  Description of Artificial Sequence: Synthetic oligonucleotide
agactctatagagtctcgg

SEQ ID NO: 13746 - DNA, 19 bp, Artificial Sequence
  Description of Artificial Sequence: Synthetic oligonucleotide
ggactctatagagtcccga

SEQ ID NO: 13747 - DNA, 19 bp, Artificial Sequence
  Description of Artificial Sequence: Synthetic oligonucleotide
ggactctatagagtcccag

SEQ ID NO: 13748 - DNA, 19 bp, Artificial Sequence
  Description of Artificial Sequence: Synthetic oligonucleotide
ggactctatagagtccagg

SEQ ID NO: 13749 - DNA, 19 bp, Artificial Sequence
  Description of Artificial Sequence: Synthetic oligonucleotide
tgactctatagagtcacgg

SEQ ID NO: 13750 - DNA, 19 bp, Artificial Sequence
  Description of Artificial Sequence: Synthetic oligonucleotide
cgactctatagagtcgccg

SEQ ID NO: 13751 - DNA, 19 bp, Artificial Sequence
  Description of Artificial Sequence: Synthetic oligonucleotide
cgactctatagagtcgctg

SEQ ID NO: 13752 - DNA, 19 bp, Artificial Sequence
  Description of Artificial Sequence: Synthetic oligonucleotide
cgactctatagagtcgtcg

SEQ ID NO: 13753 - DNA, 19 bp, Artificial Sequence
  Description of Artificial Sequence: Synthetic oligonucleotide
agactctatagagtctccg

SEQ ID NO: 13754 - DNA, 19 bp, Artificial Sequence
  Description of Artificial Sequence: Synthetic oligonucleotide
cgactctatagagtcgcag

SEQ ID NO: 13755 - DNA, 19 bp, Artificial Sequence
  Description of Artificial Sequence: Synthetic oligonucleotide
tgactctatagagtcaccg

SEQ ID NO: 13756 - DNA, 19 bp, Artificial Sequence
  Description of Artificial Sequence: Synthetic oligonucleotide
ggactctatagagtccgtg

SEQ ID NO: 13757 - DNA, 19 bp, Artificial Sequence
  Description of Artificial Sequence: Synthetic oligonucleotide
agactctatagagtctggg

SEQ ID NO: 13758 - DNA, 19 bp, Artificial Sequence
  Description of Artificial Sequence: Synthetic oligonucleotide
ggactctatagagtccgag

SEQ ID NO: 13759 - DNA, 19 bp, Artificial Sequence
  Description of Artificial Sequence: Synthetic oligonucleotide
tgactctatagagtcaggg

SEQ ID NO: 13760 - DNA, 19 bp, Artificial Sequence
  Description of Artificial Sequence: Synthetic oligonucleotide
cgactctatagagtcgtgg

SEQ ID NO: 13761 - DNA, 19 bp, Artificial Sequence
  Description of Artificial Sequence: Synthetic oligonucleotide
cgactctatagagtcggct

SEQ ID NO: 13762 - DNA, 19 bp, Artificial Sequence
  Description of Artificial Sequence: Synthetic oligonucleotide
cgactctatagagtcggca

SEQ ID NO: 13763 - DNA, 19 bp, Artificial Sequence
  Description of Artificial Sequence: Synthetic oligonucleotide
agactctatagagtctcgc

SEQ ID NO: 13764 - DNA, 19 bp, Artificial Sequence
  Description of Artificial Sequence: Synthetic oligonucleotide
tgactctatagagtcacgc

SEQ ID NO: 13765 - DNA, 19 bp, Artificial Sequence
  Description of Artificial Sequence: Synthetic oligonucleotide
ggactctatagagtcctgc

SEQ ID NO: 13766 - DNA, 19 bp, Artificial Sequence
  Description of Artificial Sequence: Synthetic oligonucleotide
ggactctatagagtccagc

SEQ ID NO: 13767 - DNA, 19 bp, Artificial Sequence
  Description of Artificial Sequence: Synthetic oligonucleotide
ggactctatagagtcctcg

SEQ ID NO: 13768 - DNA, 19 bp, Artificial Sequence
  Description of Artificial Sequence: Synthetic oligonucleotide
ggactctatagagtccacg

SEQ ID NO: 13769 - DNA, 19 bp, Artificial Sequence
  Description of Artificial Sequence: Synthetic oligonucleotide
cgactctatagagtcggtg

SEQ ID NO: 13770 - DNA, 19 bp, Artificial Sequence
  Description of Artificial Sequence: Synthetic oligonucleotide
cgactctatagagtcggag

SEQ ID NO: 13771 - DNA, 19 bp, Artificial Sequence
  Description of Artificial Sequence: Synthetic oligonucleotide
ggactctatagagtcccgc

SEQ ID NO: 13772 - DNA, 19 bp, Artificial Sequence
  Description of Artificial Sequence: Synthetic oligonucleotide
ggactctatagagtccctc

SEQ ID NO: 13773 - DNA, 19 bp, Artificial Sequence
  Description of Artificial Sequence: Synthetic oligonucleotide
ggactctatagagtcccac

SEQ ID NO: 13774 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcatatgagtcnnnn

SEQ ID NO: 13775 - DNA, 19 bp, Artificial Sequence
  Description of Artificial Sequence: Synthetic oligonucleotide
ggactcatatgagtccgcc

SEQ ID NO: 13776 - DNA, 19 bp, Artificial Sequence
  Description of Artificial Sequence: Synthetic oligonucleotide
ggactcatatgagtccgct

SEQ ID NO: 13777 - DNA, 19 bp, Artificial Sequence
  Description of Artificial Sequence: Synthetic oligonucleotide
ggactcatatgagtccgtc

SEQ ID NO: 13778 - DNA, 19 bp, Artificial Sequence
  Description of Artificial Sequence: Synthetic oligonucleotide
ggactcatatgagtcctcc

SEQ ID NO: 13779 - DNA, 19 bp, Artificial Sequence
  Description of Artificial Sequence: Synthetic oligonucleotide
agactcatatgagtctgcc

SEQ ID NO: 13780 - DNA, 19 bp, Artificial Sequence
  Description of Artificial Sequence: Synthetic oligonucleotide
ggactcatatgagtccgca

SEQ ID NO: 13781 - DNA, 19 bp, Artificial Sequence
  Description of Artificial Sequence: Synthetic oligonucleotide
ggactcatatgagtccgac

SEQ ID NO: 13782 - DNA, 19 bp, Artificial Sequence
  Description of Artificial Sequence: Synthetic oligonucleotide
ggactcatatgagtccacc

SEQ ID NO: 13783 - DNA, 19 bp, Artificial Sequence
  Description of Artificial Sequence: Synthetic oligonucleotide
tgactcatatgagtcagcc

SEQ ID NO: 13784 - DNA, 19 bp, Artificial Sequence
  Description of Artificial Sequence: Synthetic oligonucleotide
cgactcatatgagtcgggc

SEQ ID NO: 13785 - DNA, 19 bp, Artificial Sequence
  Description of Artificial Sequence: Synthetic oligonucleotide
cgactcatatgagtcgggt

SEQ ID NO: 13786 - DNA, 19 bp, Artificial Sequence
  Description of Artificial Sequence: Synthetic oligonucleotide
cgactcatatgagtcggtc

SEQ ID NO: 13787 - DNA, 19 bp, Artificial Sequence
  Description of Artificial Sequence: Synthetic oligonucleotide
cgactcatatgagtcgtgc

SEQ ID NO: 13788 - DNA, 19 bp, Artificial Sequence
  Description of Artificial Sequence: Synthetic oligonucleotide
agactcatatgagtctggc

SEQ ID NO: 13789 - DNA, 19 bp, Artificial Sequence
  Description of Artificial Sequence: Synthetic oligonucleotide
cgactcatatgagtcggga

SEQ ID NO: 13790 - DNA, 19 bp, Artificial Sequence
  Description of Artificial Sequence: Synthetic oligonucleotide
cgactcatatgagtcggac

SEQ ID NO: 13791 - DNA, 19 bp, Artificial Sequence
  Description of Artificial Sequence: Synthetic oligonucleotide
tgactcatatgagtcaggc

SEQ ID NO: 13792 - DNA, 19 bp, Artificial Sequence
  Description of Artificial Sequence: Synthetic oligonucleotide
cgactcatatgagtcgccc

SEQ ID NO: 13793 - DNA, 19 bp, Artificial Sequence
  Description of Artificial Sequence: Synthetic oligonucleotide
cgactcatatgagtcgcct

SEQ ID NO: 13794 - DNA, 19 bp, Artificial Sequence
  Description of Artificial Sequence: Synthetic oligonucleotide
cgactcatatgagtcgctc

SEQ ID NO: 13795 - DNA, 19 bp, Artificial Sequence
  Description of Artificial Sequence: Synthetic oligonucleotide
cgactcatatgagtcgtcc

SEQ ID NO: 13796 - DNA, 19 bp, Artificial Sequence
  Description of Artificial Sequence: Synthetic oligonucleotide
agactcatatgagtctccc

SEQ ID NO: 13797 - DNA, 19 bp, Artificial Sequence
  Description of Artificial Sequence: Synthetic oligonucleotide
cgactcatatgagtcgcca

SEQ ID NO: 13798 - DNA, 19 bp, Artificial Sequence
  Description of Artificial Sequence: Synthetic oligonucleotide
cgactcatatgagtcgcac

SEQ ID NO: 13799 - DNA, 19 bp, Artificial Sequence
  Description of Artificial Sequence: Synthetic oligonucleotide
tgactcatatgagtcaccc

SEQ ID NO: 13800 - DNA, 19 bp, Artificial Sequence
  Description of Artificial Sequence: Synthetic oligonucleotide
ggactcatatgagtcccgt

SEQ ID NO: 13801 - DNA, 19 bp, Artificial Sequence
  Description of Artificial Sequence: Synthetic oligonucleotide
ggactcatatgagtccctg

SEQ ID NO: 13802 - DNA, 19 bp, Artificial Sequence
  Description of Artificial Sequence: Synthetic oligonucleotide
ggactcatatgagtcctgg

SEQ ID NO: 13803 - DNA, 19 bp, Artificial Sequence
  Description of Artificial Sequence: Synthetic oligonucleotide
agactcatatgagtctcgg

SEQ ID NO: 13804 - DNA, 19 bp, Artificial Sequence
  Description of Artificial Sequence: Synthetic oligonucleotide
ggactcatatgagtcccga

SEQ ID NO: 13805 - DNA, 19 bp, Artificial Sequence
  Description of Artificial Sequence: Synthetic oligonucleotide
ggactcatatgagtcccag

SEQ ID NO: 13806 - DNA, 19 bp, Artificial Sequence
  Description of Artificial Sequence: Synthetic oligonucleotide
ggactcatatgagtccagg

SEQ ID NO: 13807 - DNA, 19 bp, Artificial Sequence
  Description of Artificial Sequence: Synthetic oligonucleotide
tgactcatatgagtcacgg

SEQ ID NO: 13808 - DNA, 19 bp, Artificial Sequence
  Description of Artificial Sequence: Synthetic oligonucleotide
cgactcatatgagtcgccg

SEQ ID NO: 13809 - DNA, 19 bp, Artificial Sequence
  Description of Artificial Sequence: Synthetic oligonucleotide
cgactcatatgagtcgctg

SEQ ID NO: 13810 - DNA, 19 bp, Artificial Sequence
  Description of Artificial Sequence: Synthetic oligonucleotide
cgactcatatgagtcgtcg

SEQ ID NO: 13811 - DNA, 19 bp, Artificial Sequence
  Description of Artificial Sequence: Synthetic oligonucleotide
agactcatatgagtctccg

SEQ ID NO: 13812 - DNA, 19 bp, Artificial Sequence
  Description of Artificial Sequence: Synthetic oligonucleotide
cgactcatatgagtcgcag

SEQ ID NO: 13813 - DNA, 19 bp, Artificial Sequence
  Description of Artificial Sequence: Synthetic oligonucleotide
tgactcatatgagtcaccg

SEQ ID NO: 13814 - DNA, 19 bp, Artificial Sequence
  Description of Artificial Sequence: Synthetic oligonucleotide
ggactcatatgagtccgtg

SEQ ID NO: 13815 - DNA, 19 bp, Artificial Sequence
  Description of Artificial Sequence: Synthetic oligonucleotide
agactcatatgagtctggg

SEQ ID NO: 13816 - DNA, 19 bp, Artificial Sequence
  Description of Artificial Sequence: Synthetic oligonucleotide
ggactcatatgagtccgag

SEQ ID NO: 13817 - DNA, 19 bp, Artificial Sequence
  Description of Artificial Sequence: Synthetic oligonucleotide
tgactcatatgagtcaggg

SEQ ID NO: 13818 - DNA, 19 bp, Artificial Sequence
  Description of Artificial Sequence: Synthetic oligonucleotide
cgactcatatgagtcgtgg

SEQ ID NO: 13819 - DNA, 19 bp, Artificial Sequence
  Description of Artificial Sequence: Synthetic oligonucleotide
cgactcatatgagtcggct

SEQ ID NO: 13820 - DNA, 19 bp, Artificial Sequence
  Description of Artificial Sequence: Synthetic oligonucleotide
cgactcatatgagtcggca

SEQ ID NO: 13821 - DNA, 19 bp, Artificial Sequence
  Description of Artificial Sequence: Synthetic oligonucleotide
agactcatatgagtctcgc

SEQ ID NO: 13822 - DNA, 19 bp, Artificial Sequence
  Description of Artificial Sequence: Synthetic oligonucleotide
tgactcatatgagtcacgc

SEQ ID NO: 13823 - DNA, 19 bp, Artificial Sequence
  Description of Artificial Sequence: Synthetic oligonucleotide
ggactcatatgagtcctgc

SEQ ID NO: 13824 - DNA, 19 bp, Artificial Sequence
  Description of Artificial Sequence: Synthetic oligonucleotide
ggactcatatgagtccagc

SEQ ID NO: 13825 - DNA, 19 bp, Artificial Sequence
  Description of Artificial Sequence: Synthetic oligonucleotide
ggactcatatgagtcctcg

SEQ ID NO: 13826 - DNA, 19 bp, Artificial Sequence
  Description of Artificial Sequence: Synthetic oligonucleotide
ggactcatatgagtccacg

SEQ ID NO: 13827 - DNA, 19 bp, Artificial Sequence
  Description of Artificial Sequence: Synthetic oligonucleotide
cgactcatatgagtcggtg

SEQ ID NO: 13828 - DNA, 19 bp, Artificial Sequence
  Description of Artificial Sequence: Synthetic oligonucleotide
cgactcatatgagtcggag

SEQ ID NO: 13829 - DNA, 19 bp, Artificial Sequence
  Description of Artificial Sequence: Synthetic oligonucleotide
ggactcatatgagtcccgc

SEQ ID NO: 13830 - DNA, 19 bp, Artificial Sequence
  Description of Artificial Sequence: Synthetic oligonucleotide
ggactcatatgagtccctc

SEQ ID NO: 13831 - DNA, 19 bp, Artificial Sequence
  Description of Artificial Sequence: Synthetic oligonucleotide
ggactcatatgagtcccac

SEQ ID NO: 13832 - DNA, 19 bp, Artificial Sequence
  Description of Artificial Sequence: Synthetic oligonucleotide
  modified_base (1)..(1): a, c, t, or g
  modified_base (16)..(19): a, c, t, or g
ngactcttaagagtcnnnn

SEQ ID NO: 13833 - DNA, 19 bp, Artificial Sequence
  Description of Artificial Sequence: Synthetic oligonucleotide
ggactcttaagagtccgcc

SEQ ID NO: 13834 - DNA, 19 bp, Artificial Sequence
  Description of Artificial Sequence: Synthetic oligonucleotide
ggactcttaagagtccgct

SEQ ID NO: 13835 - DNA, 19 bp, Artificial Sequence
  Description of Artificial Sequence: Synthetic oligonucleotide
ggactcttaagagtccgtc

SEQ ID NO: 13836 - DNA, 19 bp, Artificial Sequence
  Description of Artificial Sequence: Synthetic oligonucleotide
ggactcttaagagtcctcc

SEQ ID NO: 13837 - DNA, 19 bp, Artificial Sequence
  Description of Artificial Sequence: Synthetic oligonucleotide
agactcttaagagtctgcc

SEQ ID NO: 13838 - DNA, 19 bp, Artificial Sequence
  Description of Artificial Sequence: Synthetic oligonucleotide
ggactcttaagagtccgca

SEQ ID NO: 13839 - DNA, 19 bp, Artificial Sequence
  Description of Artificial Sequence: Synthetic oligonucleotide
ggactcttaagagtccgac

SEQ ID NO: 13840 - DNA, 19 bp, Artificial Sequence
  Description of Artificial Sequence: Synthetic oligonucleotide
ggactcttaagagtccacc

SEQ ID NO: 13841 - DNA, 19 bp, Artificial Sequence
  Description of Artificial Sequence: Synthetic oligonucleotide
tgactcttaagagtcagcc

SEQ ID NO: 13842 - DNA, 19 bp, Artificial Sequence
  Description of Artificial Sequence: Synthetic oligonucleotide
cgactcttaagagtcgggc

SEQ ID NO: 13843 - DNA, 19 bp, Artificial Sequence
  Description of Artificial Sequence: Synthetic oligonucleotide
cgactcttaagagtcgggt

SEQ ID NO: 13844 - DNA, 19 bp, Artificial Sequence
  Description of Artificial Sequence: Synthetic oligonucleotide
cgactcttaagagtcggtc

SEQ ID NO: 13845 - DNA, 19 bp, Artificial Sequence
  Description of Artificial Sequence: Synthetic oligonucleotide
cgactcttaagagtcgtgc

SEQ ID NO: 13846 - DNA, 19 bp, Artificial Sequence
  Description of Artificial Sequence: Synthetic oligonucleotide
agactcttaagagtctggc

SEQ ID NO: 13847 - DNA, 19 bp, Artificial Sequence
  Description of Artificial Sequence: Synthetic oligonucleotide
cgactcttaagagtcggga

SEQ ID NO: 13848 - DNA, 19 bp, Artificial Sequence
  Description of Artificial Sequence: Synthetic oligonucleotide
cgactcttaagagtcggac

SEQ ID NO: 13849 - DNA, 19 bp, Artificial Sequence
  Description of Artificial Sequence: Synthetic oligonucleotide
tgactcttaagagtcaggc

SEQ ID NO: 13850 - DNA, 19 bp, Artificial Sequence
  Description of Artificial Sequence: Synthetic oligonucleotide
cgactcttaagagtcgccc

SEQ ID NO: 13851 - DNA, 19 bp, Artificial Sequence
  Description of Artificial Sequence: Synthetic oligonucleotide
cgactcttaagagtcgcct

SEQ ID NO: 13852 - DNA, 19 bp, Artificial Sequence
  Description of Artificial Sequence: Synthetic oligonucleotide
cgactcttaagagtcgctc

SEQ ID NO: 13853 - DNA, 19 bp, Artificial Sequence
  Description of Artificial Sequence: Synthetic oligonucleotide
cgactcttaagagtcgtcc

SEQ ID NO: 13854 - DNA, 19 bp, Artificial Sequence
  Description of Artificial Sequence: Synthetic oligonucleotide
agactcttaagagtctccc

SEQ ID NO: 13855 - DNA, 19 bp, Artificial Sequence
  Description of Artificial Sequence: Synthetic oligonucleotide
cgactcttaagagtcgcca

SEQ ID NO: 13856 - DNA, 19 bp, Artificial Sequence
  Description of Artificial Sequence: Synthetic oligonucleotide
cgactcttaagagtcgcac

SEQ ID NO: 13857 - DNA, 19 bp, Artificial Sequence
  Description of Artificial Sequence: Synthetic oligonucleotide
tgactcttaagagtcaccc

SEQ ID NO: 13858 - DNA, 19 bp, Artificial Sequence
  Description of Artificial Sequence: Synthetic oligonucleotide
ggactcttaagagtcccgt

SEQ ID NO: 13859 - DNA, 19 bp, Artificial Sequence
  Description of Artificial Sequence: Synthetic oligonucleotide
ggactcttaagagtccctg

SEQ ID NO: 13860 - DNA, 19 bp, Artificial Sequence
  Description of Artificial Sequence: Synthetic oligonucleotide
ggactcttaagagtcctgg

SEQ ID NO: 13861 - DNA, 19 bp, Artificial Sequence
  Description of Artificial Sequence: Synthetic oligonucleotide
agactcttaagagtctcgg

SEQ ID NO: 13862 - DNA, 19 bp, Artificial Sequence
  Description of Artificial Sequence: Synthetic oligonucleotide
ggactcttaagagtcccga

SEQ ID NO: 13863 - DNA, 19 bp, Artificial Sequence
  Description of Artificial Sequence: Synthetic oligonucleotide
ggactcttaagagtcccag

SEQ ID NO: 13864 - DNA, 19 bp, Artificial Sequence
  Description of Artificial Sequence: Synthetic oligonucleotide
ggactcttaagagtccagg

SEQ ID NO: 13865 - DNA, 19 bp, Artificial Sequence
  Description of Artificial Sequence: Synthetic oligonucleotide
tgactcttaagagtcacgg

SEQ ID NO: 13866 - DNA, 19 bp, Artificial Sequence
  Description of Artificial Sequence: Synthetic oligonucleotide
cgactcttaagagtcgccg

SEQ ID NO: 13867 - DNA, 19 bp, Artificial Sequence
  Description of Artificial Sequence: Synthetic oligonucleotide
cgactcttaagagtcgctg

SEQ ID NO: 13868 - DNA, 19 bp, Artificial Sequence
  Description of Artificial Sequence: Synthetic oligonucleotide
cgactcttaagagtcgtcg

SEQ ID NO: 13869 - DNA, 19 bp, Artificial Sequence
  Description of Artificial Sequence: Synthetic oligonucleotide
agactcttaagagtctccg

SEQ ID NO: 13870 - DNA, 19 bp, Artificial Sequence
  Description of Artificial Sequence: Synthetic oligonucleotide
cgactcttaagagtcgcag

SEQ ID NO: 13871 - DNA, 19 bp, Artificial Sequence
  Description of Artificial Sequence: Synthetic oligonucleotide
tgactcttaagagtcaccg

SEQ ID NO: 13872 - DNA, 19 bp, Artificial Sequence
  Description of Artificial Sequence: Synthetic oligonucleotide
ggactcttaagagtccgtg

SEQ ID NO: 13873 - DNA, 19 bp, Artificial Sequence
  Description of Artificial Sequence: Synthetic oligonucleotide
agactcttaagagtctggg

SEQ ID NO: 13874 - DNA, 19 bp, Artificial Sequence
  Description of Artificial Sequence: Synthetic oligonucleotide
ggactcttaagagtccgag

SEQ ID NO: 13875 - DNA, 19 bp, Artificial Sequence
  Description of Artificial Sequence: Synthetic oligonucleotide
tgactcttaagagtcaggg

SEQ ID NO: 13876 - DNA, 19 bp, Artificial Sequence
  Description of Artificial Sequence: Synthetic oligonucleotide
cgactcttaagagtcgtgg

SEQ ID NO: 13877 - DNA, 19 bp, Artificial Sequence
  Description of Artificial Sequence: Synthetic oligonucleotide
cgactcttaagagtcggct

SEQ ID NO: 13878 - DNA, 19 bp, Artificial Sequence
  Description of Artificial Sequence: Synthetic oligonucleotide
cgactcttaagagtcggca

SEQ ID NO: 13879 - DNA, 19 bp, Artificial Sequence
  Description of Artificial Sequence: Synthetic oligonucleotide
agactcttaagagtctcgc

SEQ ID NO: 13880 - DNA, 19 bp, Artificial Sequence
  Description of Artificial Sequence: Synthetic oligonucleotide
tgactcttaagagtcacgc

SEQ ID NO: 13881 - DNA, 19 bp, Artificial Sequence
  Description of Artificial Sequence: Synthetic oligonucleotide
ggactcttaagagtcctgc

SEQ ID NO: 13882 - DNA, 19 bp, Artificial Sequence
  Description of Artificial Sequence: Synthetic oligonucleotide
ggactcttaagagtccagc

SEQ ID NO: 13883 - DNA, 19 bp, Artificial Sequence
  Description of Artificial Sequence: Synthetic oligonucleotide
ggactcttaagagtcctcg

SEQ ID NO: 13884 - DNA, 19 bp, Artificial Sequence
  Description of Artificial Sequence: Synthetic oligonucleotide
ggactcttaagagtccacg

SEQ ID NO: 13885 - DNA, 19 bp, Artificial Sequence
  Description of Artificial Sequence: Synthetic oligonucleotide
cgactcttaagagtcggtg

SEQ ID NO: 13886 - DNA, 19 bp, Artificial Sequence
  Description of Artificial Sequence: Synthetic oligonucleotide
cgactcttaagagtcggag

SEQ ID NO: 13887 - DNA, 19 bp, Artificial Sequence
  Description of Artificial Sequence: Synthetic oligonucleotide
ggactcttaagagtcccgc

SEQ ID NO: 13888 - DNA, 19 bp, Artificial Sequence
  Description of Artificial Sequence: Synthetic oligonucleotide
ggactcttaagagtccctc

SEQ ID NO: 13889 - DNA, 19 bp, Artificial Sequence
  Description of Artificial Sequence: Synthetic oligonucleotide
ggactcttaagagtcccac

SEQ ID NO: 13890 - DNA, 19 bp, Artificial Sequence
  Description of Artificial Sequence: Synthetic oligonucleotide
  modified_base (1)..(1): a, c, t, or g
  modified_base (7)..(10): a, c, t, or g
  modified_base (16)..(19): a, c, t, or g
ngactcnnnngagtcnnnn

SEQ ID NO: 13891 - DNA, 20 bp, Artificial Sequence
  Description of Artificial Sequence: Synthetic oligonucleotide
tatgactccgcggagtcata

SEQ ID NO: 13892 - DNA, 20 bp, Artificial Sequence
  Description of Artificial Sequence: Synthetic oligonucleotide
aatgactccgcggagtcatt

SEQ ID NO: 13893 - DNA, 20 bp, Artificial Sequence
  Description of Artificial Sequence: Synthetic oligonucleotide
gatgactccgcggagtcatc

SEQ ID NO: 13894 - DNA, 20 bp, Artificial Sequence
  Description of Artificial Sequence: Synthetic oligonucleotide
taagactccgcggagtctta

SEQ ID NO: 13895 - DNA, 20 bp, Artificial Sequence
  Description of Artificial Sequence: Synthetic oligonucleotide
aaagactccgcggagtcttt

SEQ ID NO: 13896 - DNA, 20 bp, Artificial Sequence
  Description of Artificial Sequence: Synthetic oligonucleotide
gaagactccgcggagtcttc

SEQ ID NO: 13897 - DNA, 20 bp, Artificial Sequence
  Description of Artificial Sequence: Synthetic oligonucleotide
caagactccgcggagtcttg

SEQ ID NO: 13898 - DNA, 20 bp, Artificial Sequence
  Description of Artificial Sequence: Synthetic oligonucleotide
taggactccgcggagtccta

SEQ ID NO: 13899 - DNA, 20 bp, Artificial Sequence
  Description of Artificial Sequence: Synthetic oligonucleotide
aaggactccgcggagtcctt

SEQ ID NO: 13900 - DNA, 20 bp, Artificial Sequence
  Description of Artificial Sequence: Synthetic oligonucleotide
gaggactccgcggagtcctc

SEQ ID NO: 13901 - DNA, 20 bp, Artificial Sequence
  Description of Artificial Sequence: Synthetic oligonucleotide
caggactccgcggagtcctg

SEQ ID NO: 13902 - DNA, 20 bp, Artificial Sequence
  Description of Artificial Sequence: Synthetic oligonucleotide
tacgactccgcggagtcgta

SEQ ID NO: 13903 - DNA, 20 bp, Artificial Sequence
  Description of Artificial Sequence: Synthetic oligonucleotide
aacgactccgcggagtcgtt

SEQ ID NO: 13904 - DNA, 20 bp, Artificial Sequence
  Description of Artificial Sequence: Synthetic oligonucleotide
gacgactccgcggagtcgtc

SEQ ID NO: 13905 - DNA, 20 bp, Artificial Sequence
  Description of Artificial Sequence: Synthetic oligonucleotide
cacgactccgcggagtcgtg

SEQ ID NO: 13906 - DNA, 20 bp, Artificial Sequence
  Description of Artificial Sequence: Synthetic oligonucleotide
tgtgactccgcggagtcaca

SEQ ID NO: 13907 - DNA, 20 bp, Artificial Sequence
  Description of Artificial Sequence: Synthetic oligonucleotide
agtgactccgcggagtcact

SEQ ID NO: 13908 - DNA, 20 bp, Artificial Sequence
  Description of Artificial Sequence: Synthetic oligonucleotide
ggtgactccgcggagtcacc

SEQ ID NO: 13909 - DNA, 20 bp, Artificial Sequence
  Description of Artificial Sequence: Synthetic oligonucleotide
cgtgactccgcggagtcacg

SEQ ID NO: 13910 - DNA, 20 bp, Artificial Sequence
  Description of Artificial Sequence: Synthetic oligonucleotide
tgagactccgcggagtctca

SEQ ID NO: 13911 - DNA, 20 bp, Artificial Sequence
  Description of Artificial Sequence: Synthetic oligonucleotide
agagactccgcggagtctct

SEQ ID NO: 13912 - DNA, 20 bp, Artificial Sequence
  Description of Artificial Sequence: Synthetic oligonucleotide
ggagactccgcggagtctcc

SEQ ID NO: 13913 - DNA, 20 bp, Artificial Sequence
  Description of Artificial Sequence: Synthetic oligonucleotide
cgagactccgcggagtctcg

SEQ ID NO: 13914 - DNA, 20 bp, Artificial Sequence
  Description of Artificial Sequence: Synthetic oligonucleotide
tgggactccgcggagtccca

SEQ ID NO: 13915 - DNA, 20 bp, Artificial Sequence
  Description of Artificial Sequence: Synthetic oligonucleotide
agggactccgcggagtccct

SEQ ID NO: 13916 - DNA, 20 bp, Artificial Sequence
  Description of Artificial Sequence: Synthetic oligonucleotide
cgggactccgcggagtcccg

SEQ ID NO: 13917 - DNA, 20 bp, Artificial Sequence
  Description of Artificial Sequence: Synthetic oligonucleotide
tgcgactccgcggagtcgca

SEQ ID NO: 13918 - DNA, 20 bp, Artificial Sequence
  Description of Artificial Sequence: Synthetic oligonucleotide
agcgactccgcggagtcgct

SEQ ID NO: 13919 - DNA, 20 bp, Artificial Sequence
  Description of Artificial Sequence: Synthetic oligonucleotide
ggcgactccgcggagtcgcc

SEQ ID NO: 13920 - DNA, 20 bp, Artificial Sequence
  Description of Artificial Sequence: Synthetic oligonucleotide
cgcgactccgcggagtcgcg

SEQ ID NO: 13921 - DNA, 20 bp, Artificial Sequence
  Description of Artificial Sequence: Synthetic oligonucleotide
tctgactccgcggagtcaga

SEQ ID NO: 13922 - DNA, 20 bp, Artificial Sequence
  Description of Artificial Sequence: Synthetic oligonucleotide
actgactccgcggagtcagt

SEQ ID NO: 13923 - DNA, 20 bp, Artificial Sequence
  Description of Artificial Sequence: Synthetic oligonucleotide
gctgactccgcggagtcagc

SEQ ID NO: 13924 - DNA, 20 bp, Artificial Sequence
  Description of Artificial Sequence: Synthetic oligonucleotide
cctgactccgcggagtcagg

SEQ ID NO: 13925 - DNA, 20 bp, Artificial Sequence
  Description of Artificial Sequence: Synthetic oligonucleotide
tcagactccgcggagtctga

SEQ ID NO: 13926 - DNA, 20 bp, Artificial Sequence
  Description of Artificial Sequence: Synthetic oligonucleotide
acagactccgcggagtctgt

SEQ ID NO: 13927 - DNA, 20 bp, Artificial Sequence
  Description of Artificial Sequence: Synthetic oligonucleotide
gcagactccgcggagtctgc

SEQ ID NO: 13928 - DNA, 20 bp, Artificial Sequence
  Description of Artificial Sequence: Synthetic oligonucleotide
ccagactccgcggagtctgg

SEQ ID NO: 13929 - DNA, 20 bp, Artificial Sequence
  Description of Artificial Sequence: Synthetic oligonucleotide
tcggactccgcggagtccga

SEQ ID NO: 13930 - DNA, 20 bp, Artificial Sequence
  Description of Artificial Sequence: Synthetic oligonucleotide
acggactccgcggagtccgt

SEQ ID NO: 13931 - DNA, 20 bp, Artificial Sequence
  Description of Artificial Sequence: Synthetic oligonucleotide
gcggactccgcggagtccgc

SEQ ID NO: 13932 - DNA, 20 bp, Artificial Sequence
  Description of Artificial Sequence: Synthetic oligonucleotide
ccggactccgcggagtccgg

SEQ ID NO: 13933 - DNA, 20 bp, Artificial Sequence
  Description of Artificial Sequence: Synthetic oligonucleotide
tccgactccgcggagtcgga

SEQ ID NO: 13934 - DNA, 20 bp, Artificial Sequence
  Description of Artificial Sequence: Synthetic oligonucleotide
accgactccgcggagtcggt

SEQ ID NO: 13935 - DNA, 20 bp, Artificial Sequence
  Description of Artificial Sequence: Synthetic oligonucleotide
gccgactccgcggagtcggc

SEQ ID NO: 13936 - DNA, 20 bp, Artificial Sequence
  Description of Artificial Sequence: Synthetic oligonucleotide
cccgactccgcggagtcggg

SEQ ID NO: 13937 - DNA, 20 bp, Artificial Sequence
  Description of Artificial Sequence: Synthetic oligonucleotide
tttgactccgcggagtcaaa

SEQ ID NO: 13938 - DNA, 20 bp, Artificial Sequence
  Description of Artificial Sequence: Synthetic oligonucleotide
attgactccgcggagtcaat

SEQ ID NO: 13939 - DNA, 20 bp, Artificial Sequence
  Description of Artificial Sequence: Synthetic oligonucleotide
gttgactccgcggagtcaac

SEQ ID NO: 13940 - DNA, 20 bp, Artificial Sequence
  Description of Artificial Sequence: Synthetic oligonucleotide
cttgactccgcggagtcaag

SEQ ID NO: 13941 - DNA, 20 bp, Artificial Sequence
  Description of Artificial Sequence: Synthetic oligonucleotide
ttagactccgcggagtctaa

SEQ ID NO: 13942 - DNA, 20 bp, Artificial Sequence
  Description of Artificial Sequence: Synthetic oligonucleotide
atagactccgcggagtctat

SEQ ID NO: 13943 - DNA, 20 bp, Artificial Sequence
  Description of Artificial Sequence: Synthetic oligonucleotide
gtagactccgcggagtctac

SEQ ID NO: 13944 - DNA, 20 bp, Artificial Sequence
  Description of Artificial Sequence: Synthetic oligonucleotide
ctagactccgcggagtctag

SEQ ID NO: 13945 - DNA, 20 bp, Artificial Sequence
  Description of Artificial Sequence: Synthetic oligonucleotide
ttggactccgcggagtccaa

SEQ ID NO: 13946 - DNA, 20 bp, Artificial Sequence
  Description of Artificial Sequence: Synthetic oligonucleotide
atggactccgcggagtccat

SEQ ID NO: 13947 - DNA, 20 bp, Artificial Sequence
  Description of Artificial Sequence: Synthetic oligonucleotide
gtggactccgcggagtccac

SEQ ID NO: 13948 - DNA, 20 bp, Artificial Sequence
  Description of Artificial Sequence: Synthetic oligonucleotide
ctggactccgcggagtccag

SEQ ID NO: 13949 - DNA, 20 bp, Artificial Sequence
  Description of Artificial Sequence: Synthetic oligonucleotide
tatgactcccgggagtcata

SEQ ID NO: 13950 - DNA, 20 bp, Artificial Sequence
  Description of Artificial Sequence: Synthetic oligonucleotide
aatgactcccgggagtcatt

SEQ ID NO: 13951 - DNA, 20 bp, Artificial Sequence
  Description of Artificial Sequence: Synthetic oligonucleotide
gatgactcccgggagtcatc

SEQ ID NO: 13952 - DNA, 20 bp, Artificial Sequence
  Description of Artificial Sequence: Synthetic oligonucleotide
taagactcccgggagtctta

SEQ ID NO: 13953 - DNA, 20 bp, Artificial Sequence
  Description of Artificial Sequence: Synthetic oligonucleotide
aaagactcccgggagtcttt

SEQ ID NO: 13954 - DNA, 20 bp, Artificial Sequence
  Description of Artificial Sequence: Synthetic oligonucleotide
gaagactcccgggagtcttc

SEQ ID NO: 13955 - DNA, 20 bp, Artificial Sequence
  Description of Artificial Sequence: Synthetic oligonucleotide
caagactcccgggagtcttg

SEQ ID NO: 13956 - DNA, 20 bp, Artificial Sequence
  Description of Artificial Sequence: Synthetic oligonucleotide
taggactcccgggagtccta

SEQ ID NO: 13957 - DNA, 20 bp, Artificial Sequence
  Description of Artificial Sequence: Synthetic oligonucleotide
aaggactcccgggagtcctt

SEQ ID NO: 13958 - DNA, 20 bp, Artificial Sequence
  Description of Artificial Sequence: Synthetic oligonucleotide
gaggactcccgggagtcctc

SEQ ID NO: 13959 - DNA, 20 bp, Artificial Sequence
  Description of Artificial Sequence: Synthetic oligonucleotide
caggactcccgggagtcctg

SEQ ID NO: 13960 - DNA, 20 bp, Artificial Sequence
  Description of Artificial Sequence: Synthetic oligonucleotide
tacgactcccgggagtcgta

SEQ ID NO: 13961 - DNA, 20 bp, Artificial Sequence
  Description of Artificial Sequence: Synthetic oligonucleotide
aacgactcccgggagtcgtt

SEQ ID NO: 13962 - DNA, 20 bp, Artificial Sequence
  Description of Artificial Sequence: Synthetic oligonucleotide
gacgactcccgggagtcgtc

SEQ ID NO: 13963 - DNA, 20 bp, Artificial Sequence
  Description of Artificial Sequence: Synthetic oligonucleotide
cacgactcccgggagtcgtg

SEQ ID NO: 13964 - DNA, 20 bp, Artificial Sequence
  Description of Artificial Sequence: Synthetic oligonucleotide
tgtgactcccgggagtcaca

SEQ ID NO: 13965 - DNA, 20 bp, Artificial Sequence
  Description of Artificial Sequence: Synthetic oligonucleotide
agtgactcccgggagtcact

SEQ ID NO: 13966 - DNA, 20 bp, Artificial Sequence
  Description of Artificial Sequence: Synthetic oligonucleotide
ggtgactcccgggagtcacc

SEQ ID NO: 13967 - DNA, 20 bp, Artificial Sequence
  Description of Artificial Sequence: Synthetic oligonucleotide
cgtgactcccgggagtcacg

SEQ ID NO: 13968 - DNA, 20 bp, Artificial Sequence
  Description of Artificial Sequence: Synthetic oligonucleotide
tgagactcccgggagtctca

SEQ ID NO: 13969 - DNA, 20 bp, Artificial Sequence
  Description of Artificial Sequence: Synthetic oligonucleotide
agagactcccgggagtctct

SEQ ID NO: 13970 - DNA, 20 bp, Artificial Sequence
  Description of Artificial Sequence: Synthetic oligonucleotide
ggagactcccgggagtctcc

SEQ ID NO: 13971 - DNA, 20 bp, Artificial Sequence
  Description of Artificial Sequence: Synthetic oligonucleotide
cgagactcccgggagtctcg

SEQ ID NO: 13972 - DNA, 20 bp, Artificial Sequence
  Description of Artificial Sequence: Synthetic oligonucleotide
tgggactcccgggagtccca

SEQ ID NO: 13973 - DNA, 20 bp, Artificial Sequence
  Description of Artificial Sequence: Synthetic oligonucleotide
agggactcccgggagtccct

SEQ ID NO: 13974 - DNA, 20 bp, Artificial Sequence
  Description of Artificial Sequence: Synthetic oligonucleotide
cgggactcccgggagtcccg

SEQ ID NO: 13975 - DNA, 20 bp, Artificial Sequence
  Description of Artificial Sequence: Synthetic oligonucleotide
tgcgactcccgggagtcgca

SEQ ID NO: 13976 - DNA, 20 bp, Artificial Sequence
  Description of Artificial Sequence: Synthetic oligonucleotide
agcgactcccgggagtcgct

SEQ ID NO: 13977 - DNA, 20 bp, Artificial Sequence
  Description of Artificial Sequence: Synthetic oligonucleotide
ggcgactcccgggagtcgcc

SEQ ID NO: 13978 - DNA, 20 bp, Artificial Sequence
  Description of Artificial Sequence: Synthetic oligonucleotide
cgcgactcccgggagtcgcg

SEQ ID NO: 13979 - DNA, 20 bp, Artificial Sequence
  Description of Artificial Sequence: Synthetic oligonucleotide
tctgactcccgggagtcaga

SEQ ID NO: 13980 - DNA, 20 bp, Artificial Sequence
  Description of Artificial Sequence: Synthetic oligonucleotide
actgactcccgggagtcagt

SEQ ID NO: 13981 - DNA, 20 bp, Artificial Sequence
  Description of Artificial Sequence: Synthetic oligonucleotide
gctgactcccgggagtcagc

SEQ ID NO: 13982 - DNA, 20 bp, Artificial Sequence
  Description of Artificial Sequence: Synthetic oligonucleotide
cctgactcccgggagtcagg

SEQ ID NO: 13983 - DNA, 20 bp, Artificial Sequence
  Description of Artificial Sequence: Synthetic oligonucleotide
tcagactcccgggagtctga

SEQ ID NO: 13984 - DNA, 20 bp, Artificial Sequence
  Description of Artificial Sequence: Synthetic oligonucleotide
acagactcccgggagtctgt

SEQ ID NO: 13985 - DNA, 20 bp, Artificial Sequence
  Description of Artificial Sequence: Synthetic oligonucleotide
gcagactcccgggagtctgc

SEQ ID NO: 13986 - DNA, 20 bp, Artificial Sequence
  Description of Artificial Sequence: Synthetic oligonucleotide
ccagactcccgggagtctgg

SEQ ID NO: 13987 - DNA, 20 bp, Artificial Sequence
  Description of Artificial Sequence: Synthetic oligonucleotide
tcggactcccgggagtccga

SEQ ID NO: 13988 - DNA, 20 bp, Artificial Sequence
  Description of Artificial Sequence: Synthetic oligonucleotide
acggactcccgggagtccgt

SEQ ID NO: 13989 - DNA, 20 bp, Artificial Sequence
  Description of Artificial Sequence: Synthetic oligonucleotide
gcggactcccgggagtccgc

SEQ ID NO: 13990 - DNA, 20 bp, Artificial Sequence
  Description of Artificial Sequence: Synthetic oligonucleotide
ccggactcccgggagtccgg

SEQ ID NO: 13991 - DNA, 20 bp, Artificial Sequence
  Description of Artificial Sequence: Synthetic oligonucleotide
tccgactcccgggagtcgga

SEQ ID NO: 13992 - DNA, 20 bp, Artificial Sequence
  Description of Artificial Sequence: Synthetic oligonucleotide
accgactcccgggagtcggt

SEQ ID NO: 13993 - DNA, 20 bp, Artificial Sequence
  Description of Artificial Sequence: Synthetic oligonucleotide
gccgactcccgggagtcggc

SEQ ID NO: 13994 - DNA, 20 bp, Artificial Sequence
  Description of Artificial Sequence: Synthetic oligonucleotide
cccgactcccgggagtcggg

SEQ ID NO: 13995 - DNA, 20 bp, Artificial Sequence
  Description of Artificial Sequence: Synthetic oligonucleotide
tttgactcccgggagtcaaa

SEQ ID NO: 13996 - DNA, 20 bp, Artificial Sequence
  Description of Artificial Sequence: Synthetic oligonucleotide
attgactcccgggagtcaat

SEQ ID NO: 13997 - DNA, 20 bp, Artificial Sequence
  Description of Artificial Sequence: Synthetic oligonucleotide
gttgactcccgggagtcaac

SEQ ID NO: 13998 - DNA, 20 bp, Artificial Sequence
  Description of Artificial Sequence: Synthetic oligonucleotide
cttgactcccgggagtcaag

SEQ ID NO: 13999 - DNA, 20 bp, Artificial Sequence
  Description of Artificial Sequence: Synthetic oligonucleotide
ttagactcccgggagtctaa

SEQ ID NO: 14000 - DNA, 20 bp, Artificial Sequence
  Description of Artificial Sequence: Synthetic oligonucleotide
atagactcccgggagtctat

SEQ ID NO: 14001 - DNA, 20 bp, Artificial Sequence
  Description of Artificial Sequence: Synthetic oligonucleotide
gtagactcccgggagtctac

SEQ ID NO: 14002 - DNA, 20 bp, Artificial Sequence
  Description of Artificial Sequence: Synthetic oligonucleotide
ctagactcccgggagtctag

SEQ ID NO: 14003 - DNA, 20 bp, Artificial Sequence
  Description of Artificial Sequence: Synthetic oligonucleotide
ttggactcccgggagtccaa

SEQ ID NO: 14004 - DNA, 20 bp, Artificial Sequence
  Description of Artificial Sequence: Synthetic oligonucleotide
atggactcccgggagtccat

SEQ ID NO: 14005 - DNA, 20 bp, Artificial Sequence
  Description of Artificial Sequence: Synthetic oligonucleotide
gtggactcccgggagtccac

SEQ ID NO: 14006 - DNA, 20 bp, Artificial Sequence
  Description of Artificial Sequence: Synthetic oligonucleotide
ctggactcccgggagtccag

SEQ ID NO: 14007 - DNA, 20 bp, Artificial Sequence
  Description of Artificial Sequence: Synthetic oligonucleotide
tatgactcggccgagtcata

SEQ ID NO: 14008 - DNA, 20 bp, Artificial Sequence
  Description of Artificial Sequence: Synthetic oligonucleotide
aatgactcggccgagtcatt

SEQ ID NO: 14009 - DNA, 20 bp, Artificial Sequence
  Description of Artificial Sequence: Synthetic oligonucleotide
gatgactcggccgagtcatc

SEQ ID NO: 14010 - DNA, 20 bp, Artificial Sequence
  Description of Artificial Sequence: Synthetic oligonucleotide
taagactcggccgagtctta

SEQ ID NO: 14011 - DNA, 20 bp, Artificial Sequence
  Description of Artificial Sequence: Synthetic oligonucleotide
aaagactcggccgagtcttt

SEQ ID NO: 14012 - DNA, 20 bp, Artificial Sequence
  Description of Artificial Sequence: Synthetic oligonucleotide
gaagactcggccgagtcttc

SEQ ID NO: 14013 - DNA, 20 bp, Artificial Sequence
  Description of Artificial Sequence: Synthetic oligonucleotide
caagactcggccgagtcttg

SEQ ID NO: 14014 - DNA, 20 bp, Artificial Sequence
  Description of Artificial Sequence: Synthetic oligonucleotide
taggactcggccgagtccta

SEQ ID NO: 14015 - DNA, 20 bp, Artificial Sequence
  Description of Artificial Sequence: Synthetic oligonucleotide
aaggactcggccgagtcctt

SEQ ID NO: 14016 - DNA, 20 bp, Artificial Sequence
  Description of Artificial Sequence: Synthetic oligonucleotide
gaggactcggccgagtcctc

SEQ ID NO: 14017 - DNA, 20 bp, Artificial Sequence
  Description of Artificial Sequence: Synthetic oligonucleotide
caggactcggccgagtcctg

SEQ ID NO: 14018 - DNA, 20 bp, Artificial Sequence
  Description of Artificial Sequence: Synthetic oligonucleotide
tacgactcggccgagtcgta

SEQ ID NO: 14019 - DNA, 20 bp, Artificial Sequence
  Description of Artificial Sequence: Synthetic oligonucleotide
aacgactcggccgagtcgtt

SEQ ID NO: 14020 - DNA, 20 bp, Artificial Sequence
  Description of Artificial Sequence: Synthetic oligonucleotide
gacgactcggccgagtcgtc

SEQ ID NO: 14021 - DNA, 20 bp, Artificial Sequence
  Description of Artificial Sequence: Synthetic oligonucleotide
cacgactcggccgagtcgtg

SEQ ID NO: 14022 - DNA, 20 bp, Artificial Sequence
  Description of Artificial Sequence: Synthetic oligonucleotide
tgtgactcggccgagtcaca

SEQ ID NO: 14023 - DNA, 20 bp, Artificial Sequence
  Description of Artificial Sequence: Synthetic oligonucleotide
agtgactcggccgagtcact

SEQ ID NO: 14024 - DNA, 20 bp, Artificial Sequence
  Description of Artificial Sequence: Synthetic oligonucleotide
ggtgactcggccgagtcacc

SEQ ID NO: 14025 - DNA, 20 bp, Artificial Sequence
  Description of Artificial Sequence: Synthetic oligonucleotide
cgtgactcggccgagtcacg

SEQ ID NO: 14026 - DNA, 20 bp, Artificial Sequence
  Description of Artificial Sequence: Synthetic oligonucleotide
tgagactcggccgagtctca

SEQ ID NO: 14027 - DNA, 20 bp, Artificial Sequence
  Description of Artificial Sequence: Synthetic oligonucleotide
agagactcggccgagtctct

SEQ ID NO: 14028 - DNA, 20 bp, Artificial Sequence
  Description of Artificial Sequence: Synthetic oligonucleotide
ggagactcggccgagtctcc

SEQ ID NO: 14029 - DNA, 20 bp, Artificial Sequence
  Description of Artificial Sequence: Synthetic oligonucleotide
cgagactcggccgagtctcg

SEQ ID NO: 14030 - DNA, 20 bp, Artificial Sequence
  Description of Artificial Sequence: Synthetic oligonucleotide
tgggactcggccgagtccca

SEQ ID NO: 14031 - DNA, 20 bp, Artificial Sequence
  Description of Artificial Sequence: Synthetic oligonucleotide
agggactcggccgagtccct

SEQ ID NO: 14032 - DNA, 20 bp, Artificial Sequence
  Description of Artificial Sequence: Synthetic oligonucleotide
cgggactcggccgagtcccg

SEQ ID NO: 14033 - DNA, 20 bp, Artificial Sequence
  Description of Artificial Sequence: Synthetic oligonucleotide
tgcgactcggccgagtcgca

SEQ ID NO: 14034 - DNA, 20 bp, Artificial Sequence
  Description of Artificial Sequence: Synthetic oligonucleotide
agcgactcggccgagtcgct

SEQ ID NO: 14035 - DNA, 20 bp, Artificial Sequence
  Description of Artificial Sequence: Synthetic oligonucleotide
ggcgactcggccgagtcgcc

SEQ ID NO: 14036 - DNA, 20 bp, Artificial Sequence
  Description of Artificial Sequence: Synthetic oligonucleotide
cgcgactcggccgagtcgcg

SEQ ID NO: 14037 - DNA, 20 bp, Artificial Sequence
  Description of Artificial Sequence: Synthetic oligonucleotide
tctgactcggccgagtcaga

SEQ ID NO: 14038 - DNA, 20 bp, Artificial Sequence
  Description of Artificial Sequence: Synthetic oligonucleotide
actgactcggccgagtcagt

SEQ ID NO: 14039 - DNA, 20 bp, Artificial Sequence
  Description of Artificial Sequence: Synthetic oligonucleotide
gctgactcggccgagtcagc

SEQ ID NO: 14040 - DNA, 20 bp, Artificial Sequence
  Description of Artificial Sequence: Synthetic oligonucleotide
cctgactcggccgagtcagg

SEQ ID NO: 14041 - DNA, 20 bp, Artificial Sequence
  Description of Artificial Sequence: Synthetic oligonucleotide
tcagactcggccgagtctga

SEQ ID NO: 14042 - DNA, 20 bp, Artificial Sequence
  Description of Artificial Sequence: Synthetic oligonucleotide
acagactcggccgagtctgt

SEQ ID NO: 14043 - DNA, 20 bp, Artificial Sequence
  Description of Artificial Sequence: Synthetic oligonucleotide
gcagactcggccgagtctgc

SEQ ID NO: 14044 - DNA, 20 bp, Artificial Sequence
  Description of Artificial Sequence: Synthetic oligonucleotide
ccagactcggccgagtctgg

SEQ ID NO: 14045 - DNA, 20 bp, Artificial Sequence
  Description of Artificial Sequence: Synthetic oligonucleotide
tcggactcggccgagtccga

SEQ ID NO: 14046 - DNA, 20 bp, Artificial Sequence
  Description of Artificial Sequence: Synthetic oligonucleotide
acggactcggccgagtccgt

SEQ ID NO: 14047 - DNA, 20 bp, Artificial Sequence
  Description of Artificial Sequence: Synthetic oligonucleotide
gcggactcggccgagtccgc

SEQ ID NO: 14048 - DNA, 20 bp, Artificial Sequence
  Description of Artificial Sequence: Synthetic oligonucleotide
ccggactcggccgagtccgg

SEQ ID NO: 14049 - DNA, 20 bp, Artificial Sequence
  Description of Artificial Sequence: Synthetic oligonucleotide
tccgactcggccgagtcgga

SEQ ID NO: 14050 - DNA, 20 bp, Artificial Sequence
  Description of Artificial Sequence: Synthetic oligonucleotide
accgactcggccgagtcggt

SEQ ID NO: 14051 - DNA, 20 bp, Artificial Sequence
  Description of Artificial Sequence: Synthetic oligonucleotide
gccgactcggccgagtcggc

SEQ ID NO: 14052 - DNA, 20 bp, Artificial Sequence
  Description of Artificial Sequence: Synthetic oligonucleotide
cccgactcggccgagtcggg

SEQ ID NO: 14053 - DNA, 20 bp, Artificial Sequence
  Description of Artificial Sequence: Synthetic oligonucleotide
tttgactcggccgagtcaaa

SEQ ID NO: 14054 - DNA, 20 bp, Artificial Sequence
  Description of Artificial Sequence: Synthetic oligonucleotide
attgactcggccgagtcaat

SEQ ID NO: 14055 - DNA, 20 bp, Artificial Sequence
  Description of Artificial Sequence: Synthetic oligonucleotide
gttgactcggccgagtcaac

SEQ ID NO: 14056 - DNA, 20 bp, Artificial Sequence
  Description of Artificial Sequence: Synthetic oligonucleotide
cttgactcggccgagtcaag

SEQ ID NO: 14057 - DNA, 20 bp, Artificial Sequence
  Description of Artificial Sequence: Synthetic oligonucleotide
ttagactcggccgagtctaa

SEQ ID NO: 14058 - DNA, 20 bp, Artificial Sequence
  Description of Artificial Sequence: Synthetic oligonucleotide
atagactcggccgagtctat

SEQ ID NO: 14059 - DNA, 20 bp, Artificial Sequence
  Description of Artificial Sequence: Synthetic oligonucleotide
gtagactcggccgagtctac

SEQ ID NO: 14060 - DNA, 20 bp, Artificial Sequence
  Description of Artificial Sequence: Synthetic oligonucleotide
ctagactcggccgagtctag

SEQ ID NO: 14061 - DNA, 20 bp, Artificial Sequence
  Description of Artificial Sequence: Synthetic oligonucleotide
ttggactcggccgagtccaa

SEQ ID NO: 14062 - DNA, 20 bp, Artificial Sequence
  Description of Artificial Sequence: Synthetic oligonucleotide
atggactcggccgagtccat

SEQ ID NO: 14063 - DNA, 20 bp, Artificial Sequence
  Description of Artificial Sequence: Synthetic oligonucleotide
gtggactcggccgagtccac

SEQ ID NO: 14064 - DNA, 20 bp, Artificial Sequence
  Description of Artificial Sequence: Synthetic oligonucleotide
ctggactcggccgagtccag

SEQ ID NO: 14065 - DNA, 20 bp, Artificial Sequence
  Description of Artificial Sequence: Synthetic oligonucleotide
aatgactctgcagagtcatt

SEQ ID NO: 14066 - DNA, 20 bp, Artificial Sequence
  Description of Artificial Sequence: Synthetic oligonucleotide
gatgactctgcagagtcatc

SEQ ID NO: 14067 - DNA, 20 bp, Artificial Sequence
  Description of Artificial Sequence: Synthetic oligonucleotide
aaagactctgcagagtcttt

SEQ ID NO: 14068 - DNA, 20 bp, Artificial Sequence
  Description of Artificial Sequence: Synthetic oligonucleotide
gaagactctgcagagtcttc

SEQ ID NO: 14069 - DNA, 20 bp, Artificial Sequence
  Description of Artificial Sequence: Synthetic oligonucleotide
caagactctgcagagtcttg

SEQ ID NO: 14070 - DNA, 20 bp, Artificial Sequence
  Description of Artificial Sequence: Synthetic oligonucleotide
taggactctgcagagtccta

SEQ ID NO: 14071 - DNA, 20 bp, Artificial Sequence
  Description of Artificial Sequence: Synthetic oligonucleotide
aaggactctgcagagtcctt

SEQ ID NO: 14072 - DNA, 20 bp, Artificial Sequence
  Description of Artificial Sequence: Synthetic oligonucleotide
gaggactctgcagagtcctc

SEQ ID NO: 14073 - DNA, 20 bp, Artificial Sequence
  Description of Artificial Sequence: Synthetic oligonucleotide
caggactctgcagagtcctg

SEQ ID NO: 14074 - DNA, 20 bp, Artificial Sequence
  Description of Artificial Sequence: Synthetic oligonucleotide
tacgactctgcagagtcgta

SEQ ID NO: 14075 - DNA, 20 bp, Artificial Sequence
  Description of Artificial Sequence: Synthetic oligonucleotide
aacgactctgcagagtcgtt

SEQ ID NO: 14076 - DNA, 20 bp, Artificial Sequence
  Description of Artificial Sequence: Synthetic oligonucleotide
gacgactctgcagagtcgtc

SEQ ID NO: 14077 - DNA, 20 bp, Artificial Sequence
  Description of Artificial Sequence: Synthetic oligonucleotide
cacgactctgcagagtcgtg

SEQ ID NO: 14078 - DNA, 20 bp, Artificial Sequence
  Description of Artificial Sequence: Synthetic oligonucleotide
tgtgactctgcagagtcaca

SEQ ID NO: 14079 - DNA, 20 bp, Artificial Sequence
  Description of Artificial Sequence: Synthetic oligonucleotide
agtgactctgcagagtcact

SEQ ID NO: 14080 - DNA, 20 bp, Artificial Sequence
  Description of Artificial Sequence: Synthetic oligonucleotide
ggtgactctgcagagtcacc

SEQ ID NO: 14081 - DNA, 20 bp, Artificial Sequence
  Description of Artificial Sequence: Synthetic oligonucleotide
cgtgactctgcagagtcacg

SEQ ID NO: 14082 - DNA, 20 bp, Artificial Sequence
  Description of Artificial Sequence: Synthetic oligonucleotide
tgagactctgcagagtctca

SEQ ID NO: 14083 - DNA, 20 bp, Artificial Sequence
  Description of Artificial Sequence: Synthetic oligonucleotide
agagactctgcagagtctct

SEQ ID NO: 14084 - DNA, 20 bp, Artificial Sequence
  Description of Artificial Sequence: Synthetic oligonucleotide
ggagactctgcagagtctcc

SEQ ID NO: 14085 - DNA, 20 bp, Artificial Sequence
  Description of Artificial Sequence: Synthetic oligonucleotide
cgagactctgcagagtctcg

SEQ ID NO: 14086 - DNA, 20 bp, Artificial Sequence
  Description of Artificial Sequence: Synthetic oligonucleotide
tgggactctgcagagtccca

SEQ ID NO: 14087 - DNA, 20 bp, Artificial Sequence
  Description of Artificial Sequence: Synthetic oligonucleotide
agggactctgcagagtccct

SEQ ID NO: 14088 - DNA, 20 bp, Artificial Sequence
  Description of Artificial Sequence: Synthetic oligonucleotide
cgggactctgcagagtcccg

SEQ ID NO: 14089 - DNA, 20 bp, Artificial Sequence
  Description of Artificial Sequence: Synthetic oligonucleotide
tgcgactctgcagagtcgca

SEQ ID NO: 14090 - DNA, 20 bp, Artificial Sequence
  Description of Artificial Sequence: Synthetic oligonucleotide
agcgactctgcagagtcgct

SEQ ID NO: 14091 - DNA, 20 bp, Artificial Sequence
  Description of Artificial Sequence: Synthetic oligonucleotide
ggcgactctgcagagtcgcc

SEQ ID NO: 14092 - DNA, 20 bp, Artificial Sequence
  Description of Artificial Sequence: Synthetic oligonucleotide
cgcgactctgcagagtcgcg

SEQ ID NO: 14093 - DNA, 20 bp, Artificial Sequence
  Description of Artificial Sequence: Synthetic oligonucleotide
tctgactctgcagagtcaga

SEQ ID NO: 14094 - DNA, 20 bp, Artificial Sequence
  Description of Artificial Sequence: Synthetic oligonucleotide
actgactctgcagagtcagt

SEQ ID NO: 14095 - DNA, 20 bp, Artificial Sequence
  Description of Artificial Sequence: Synthetic oligonucleotide
gctgactctgcagagtcagc

SEQ ID NO: 14096 - DNA, 20 bp, Artificial Sequence
  Description of Artificial Sequence: Synthetic oligonucleotide
cctgactctgcagagtcagg

SEQ ID NO: 14097 - DNA, 20 bp, Artificial Sequence
  Description of Artificial Sequence: Synthetic oligonucleotide
tcagactctgcagagtctga

SEQ ID NO: 14098 - DNA, 20 bp, Artificial Sequence
  Description of Artificial Sequence: Synthetic oligonucleotide
acagactctgcagagtctgt

SEQ ID NO: 14099 - DNA, 20 bp, Artificial Sequence
  Description of Artificial Sequence: Synthetic oligonucleotide
gcagactctgcagagtctgc

SEQ ID NO: 14100 - DNA, 20 bp, Artificial Sequence
  Description of Artificial Sequence: Synthetic oligonucleotide
ccagactctgcagagtctgg

SEQ ID NO: 14101 - DNA, 20 bp, Artificial Sequence
  Description of Artificial Sequence: Synthetic oligonucleotide
tcggactctgcagagtccga

SEQ ID NO: 14102 - DNA, 20 bp, Artificial Sequence
  Description of Artificial Sequence: Synthetic oligonucleotide
acggactctgcagagtccgt

SEQ ID NO: 14103 - DNA, 20 bp, Artificial Sequence
  Description of Artificial Sequence: Synthetic oligonucleotide
gcggactctgcagagtccgc

SEQ ID NO: 14104 - DNA, 20 bp, Artificial Sequence
  Description of Artificial Sequence: Synthetic oligonucleotide
ccggactctgcagagtccgg

SEQ ID NO: 14105 - DNA, 20 bp, Artificial Sequence
  Description of Artificial Sequence: Synthetic oligonucleotide
tccgactctgcagagtcgga

SEQ ID NO: 14106 - DNA, 20 bp, Artificial Sequence
  Description of Artificial Sequence: Synthetic oligonucleotide
accgactctgcagagtcggt

SEQ ID NO: 14107 - DNA, 20 bp, Artificial Sequence
  Description of Artificial Sequence: Synthetic oligonucleotide
gccgactctgcagagtcggc

SEQ ID NO: 14108 - DNA, 20 bp, Artificial Sequence
  Description of Artificial Sequence: Synthetic oligonucleotide
cccgactctgcagagtcggg

SEQ ID NO: 14109 - DNA, 20 bp, Artificial Sequence
  Description of Artificial Sequence: Synthetic oligonucleotide
tttgactctgcagagtcaaa

SEQ ID NO: 14110 - DNA, 20 bp, Artificial Sequence
  Description of Artificial Sequence: Synthetic oligonucleotide
attgactctgcagagtcaat

SEQ ID NO: 14111 - DNA, 20 bp, Artificial Sequence
  Description of Artificial Sequence: Synthetic oligonucleotide
gttgactctgcagagtcaac

SEQ ID NO: 14112 - DNA, 20 bp, Artificial Sequence
  Description of Artificial Sequence: Synthetic oligonucleotide
cttgactctgcagagtcaag

SEQ ID NO: 14113 - DNA, 20 bp, Artificial Sequence
  Description of Artificial Sequence: Synthetic oligonucleotide
gtagactctgcagagtctac

SEQ ID NO: 14114 - DNA, 20 bp, Artificial Sequence
  Description of Artificial Sequence: Synthetic oligonucleotide
ctagactctgcagagtctag

SEQ ID NO: 14115 - DNA, 20 bp, Artificial Sequence
  Description of Artificial Sequence: Synthetic oligonucleotide
ttggactctgcagagtccaa

SEQ ID NO: 14116 - DNA, 20 bp, Artificial Sequence
  Description of Artificial Sequence: Synthetic oligonucleotide
atggactctgcagagtccat

SEQ ID NO: 14117 - DNA, 20 bp, Artificial Sequence
  Description of Artificial Sequence: Synthetic oligonucleotide
gtggactctgcagagtccac

SEQ ID NO: 14118 - DNA, 20 bp, Artificial Sequence
  Description of Artificial Sequence: Synthetic oligonucleotide
ctggactctgcagagtccag

SEQ ID NO: 14119 - DNA, 20 bp, Artificial Sequence
  Description of Artificial Sequence: Synthetic oligonucleotide
taggactcagctgagtccta

SEQ ID NO: 14120 - DNA, 20 bp, Artificial Sequence
  Description of Artificial Sequence: Synthetic oligonucleotide
tgtgactcagctgagtcaca

SEQ ID NO: 14121 - DNA, 20 bp, Artificial Sequence
  Description of Artificial Sequence: Synthetic oligonucleotide
tgagactcagctgagtctca

SEQ ID NO: 14122 - DNA, 20 bp, Artificial Sequence
  Description of Artificial Sequence: Synthetic oligonucleotide
tgggactcagctgagtccca

SEQ ID NO: 14123 - DNA, 20 bp, Artificial Sequence
  Description of Artificial Sequence: Synthetic oligonucleotide
tgcgactcagctgagtcgca

SEQ ID NO: 14124 - DNA, 20 bp, Artificial Sequence
  Description of Artificial Sequence: Synthetic oligonucleotide
tctgactcagctgagtcaga

SEQ ID NO: 14125 - DNA, 20 bp, Artificial Sequence
  Description of Artificial Sequence: Synthetic oligonucleotide
tcagactcagctgagtctga

SEQ ID NO: 14126 - DNA, 20 bp, Artificial Sequence
  Description of Artificial Sequence: Synthetic oligonucleotide
tcggactcagctgagtccga

SEQ ID NO: 14127 - DNA, 20 bp, Artificial Sequence
  Description of Artificial Sequence: Synthetic oligonucleotide
tccgactcagctgagtcgga

SEQ ID NO: 14128 - DNA, 20 bp, Artificial Sequence
  Description of Artificial Sequence: Synthetic oligonucleotide
tttgactcagctgagtcaaa

SEQ ID NO: 14129 - DNA, 20 bp, Artificial Sequence
  Description of Artificial Sequence: Synthetic oligonucleotide
ttggactcagctgagtccaa

SEQ ID NO: 14130 - DNA, 20 bp, Artificial Sequence
  Description of Artificial Sequence: Synthetic oligonucleotide
taggactctcgagagtccta

SEQ ID NO: 14131 - DNA, 20 bp, Artificial Sequence
  Description of Artificial Sequence: Synthetic oligonucleotide
tacgactctcgagagtcgta

SEQ ID NO: 14132 - DNA, 20 bp, Artificial Sequence
  Description of Artificial Sequence: Synthetic oligonucleotide
tgtgactctcgagagtcaca

SEQ ID NO: 14133 - DNA, 20 bp, Artificial Sequence
  Description of Artificial Sequence: Synthetic oligonucleotide
tgagactctcgagagtctca

SEQ ID NO: 14134 - DNA, 20 bp, Artificial Sequence
  Description of Artificial Sequence: Synthetic oligonucleotide
tgggactctcgagagtccca

SEQ ID NO: 14135 - DNA, 20 bp, Artificial Sequence
  Description of Artificial Sequence: Synthetic oligonucleotide
tgcgactctcgagagtcgca

SEQ ID NO: 14136 - DNA, 20 bp, Artificial Sequence
  Description of Artificial Sequence: Synthetic oligonucleotide
tctgactctcgagagtcaga

SEQ ID NO: 14137 - DNA, 20 bp, Artificial Sequence
  Description of Artificial Sequence: Synthetic oligonucleotide
tcagactctcgagagtctga

SEQ ID NO: 14138 - DNA, 20 bp, Artificial Sequence
  Description of Artificial Sequence: Synthetic oligonucleotide
tcggactctcgagagtccga

SEQ ID NO: 14139 - DNA, 20 bp, Artificial Sequence
  Description of Artificial Sequence: Synthetic oligonucleotide
tttgactctcgagagtcaaa

SEQ ID NO: 14140 - DNA, 20 bp, Artificial Sequence
  Description of Artificial Sequence: Synthetic oligonucleotide
ttggactctcgagagtccaa

SEQ ID NO: 14141 - DNA, 20 bp, Artificial Sequence
  Description of Artificial Sequence: Synthetic oligonucleotide
tatgactcacgtgagtcata

SEQ ID NO: 14142 - DNA, 20 bp, Artificial Sequence
  Description of Artificial Sequence: Synthetic oligonucleotide
taggactcacgtgagtccta

SEQ ID NO: 14143 - DNA, 20 bp, Artificial Sequence
  Description of Artificial Sequence: Synthetic oligonucleotide
tacgactcacgtgagtcgta

SEQ ID NO: 14144 - DNA, 20 bp, Artificial Sequence
  Description of Artificial Sequence: Synthetic oligonucleotide
tgtgactcacgtgagtcaca

SEQ ID NO: 14145 - DNA, 20 bp, Artificial Sequence
  Description of Artificial Sequence: Synthetic oligonucleotide
tgagactcacgtgagtctca

SEQ ID NO: 14146 - DNA, 20 bp, Artificial Sequence
  Description of Artificial Sequence: Synthetic oligonucleotide
tgggactcacgtgagtccca

SEQ ID NO: 14147 - DNA, 20 bp, Artificial Sequence
  Description of Artificial Sequence: Synthetic oligonucleotide
tgcgactcacgtgagtcgca

SEQ ID NO: 14148 - DNA, 20 bp, Artificial Sequence
  Description of Artificial Sequence: Synthetic oligonucleotide
tctgactcacgtgagtcaga

SEQ ID NO: 14149 - DNA, 20 bp, Artificial Sequence
  Description of Artificial Sequence: Synthetic oligonucleotide
tcagactcacgtgagtctga

SEQ ID NO: 14150 - DNA, 20 bp, Artificial Sequence
  Description of Artificial Sequence: Synthetic oligonucleotide
tcggactcacgtgagtccga

SEQ ID NO: 14151 - DNA, 20 bp, Artificial Sequence
  Description of Artificial Sequence: Synthetic oligonucleotide
tccgactcacgtgagtcgga

SEQ ID NO: 14152 - DNA, 20 bp, Artificial Sequence
  Description of Artificial Sequence: Synthetic oligonucleotide
tttgactcacgtgagtcaaa

SEQ ID NO: 14153 - DNA, 20 bp, Artificial Sequence
  Description of Artificial Sequence: Synthetic oligonucleotide
ttggactcacgtgagtccaa

SEQ ID NO: 14154 - DNA, 20 bp, Artificial Sequence
  Description of Artificial Sequence: Synthetic oligonucleotide
taggactccatggagtccta

SEQ ID NO: 14155 - DNA, 20 bp, Artificial Sequence
  Description of Artificial Sequence: Synthetic oligonucleotide
tacgactccatggagtcgta

SEQ ID NO: 14156 - DNA, 20 bp, Artificial Sequence
  Description of Artificial Sequence: Synthetic oligonucleotide
tgtgactccatggagtcaca

SEQ ID NO: 14157 - DNA, 20 bp, Artificial Sequence
  Description of Artificial Sequence: Synthetic oligonucleotide
tgagactccatggagtctca

SEQ ID NO: 14158 - DNA, 20 bp, Artificial Sequence
  Description of Artificial Sequence: Synthetic oligonucleotide
tgggactccatggagtccca

SEQ ID NO: 14159 - DNA, 20 bp, Artificial Sequence
  Description of Artificial Sequence: Synthetic oligonucleotide
tgcgactccatggagtcgca

SEQ ID NO: 14160 - DNA, 20 bp, Artificial Sequence
  Description of Artificial Sequence: Synthetic oligonucleotide
tctgactccatggagtcaga

SEQ ID NO: 14161 - DNA, 20 bp, Artificial Sequence
  Description of Artificial Sequence: Synthetic oligonucleotide
tcagactccatggagtctga

SEQ ID NO: 14162 - DNA, 20 bp, Artificial Sequence
  Description of Artificial Sequence: Synthetic oligonucleotide
tcggactccatggagtccga

SEQ ID NO: 14163 - DNA, 20 bp, Artificial Sequence
  Description of Artificial Sequence: Synthetic oligonucleotide
tccgactccatggagtcgga

SEQ ID NO: 14164 - DNA, 20 bp, Artificial Sequence
  Description of Artificial Sequence: Synthetic oligonucleotide
tttgactccatggagtcaaa

SEQ ID NO: 14165 - DNA, 20 bp, Artificial Sequence
  Description of Artificial Sequence: Synthetic oligonucleotide
ttggactccatggagtccaa

SEQ ID NO: 14166 - DNA, 20 bp, Artificial Sequence
  Description of Artificial Sequence: Synthetic oligonucleotide
taggactcgtacgagtccta

SEQ ID NO: 14167 - DNA, 20 bp, Artificial Sequence
  Description of Artificial Sequence: Synthetic oligonucleotide
tacgactcgtacgagtcgta

SEQ ID NO: 14168 - DNA, 20 bp, Artificial Sequence
  Description of Artificial Sequence: Synthetic oligonucleotide
tgtgactcgtacgagtcaca

SEQ ID NO: 14169 - DNA, 20 bp, Artificial Sequence
  Description of Artificial Sequence: Synthetic oligonucleotide
tgagactcgtacgagtctca

SEQ ID NO: 14170 - DNA, 20 bp, Artificial Sequence
  Description of Artificial Sequence: Synthetic oligonucleotide
tgggactcgtacgagtccca

SEQ ID NO: 14171 - DNA, 20 bp, Artificial Sequence
  Description of Artificial Sequence: Synthetic oligonucleotide
tgcgactcgtacgagtcgca

SEQ ID NO: 14172 - DNA, 20 bp, Artificial Sequence
  Description of Artificial Sequence: Synthetic oligonucleotide
tctgactcgtacgagtcaga

SEQ ID NO: 14173 - DNA, 20 bp, Artificial Sequence
  Description of Artificial Sequence: Synthetic oligonucleotide
tcagactcgtacgagtctga

SEQ ID NO: 14174 - DNA, 20 bp, Artificial Sequence
  Description of Artificial Sequence: Synthetic oligonucleotide
tcggactcgtacgagtccga

SEQ ID NO: 14175 - DNA, 20 bp, Artificial Sequence
  Description of Artificial Sequence: Synthetic oligonucleotide
tccgactcgtacgagtcgga

SEQ ID NO: 14176 - DNA, 20 bp, Artificial Sequence
  Description of Artificial Sequence: Synthetic oligonucleotide
tttgactcgtacgagtcaaa

SEQ ID NO: 14177 - DNA, 20 bp, Artificial Sequence
  Description of Artificial Sequence: Synthetic oligonucleotide
ttggactcgtacgagtccaa

SEQ ID NO: 14178 - DNA, 20 bp, Artificial Sequence
  Description of Artificial Sequence: Synthetic oligonucleotide
taggactcctaggagtccta

SEQ ID NO: 14179 - DNA, 20 bp, Artificial Sequence
  Description of Artificial Sequence: Synthetic oligonucleotide
tacgactcctaggagtcgta

SEQ ID NO: 14180 - DNA, 20 bp, Artificial Sequence
  Description of Artificial Sequence: Synthetic oligonucleotide
tgtgactcctaggagtcaca

SEQ ID NO: 14181 - DNA, 20 bp, Artificial Sequence
  Description of Artificial Sequence: Synthetic oligonucleotide
tgagactcctaggagtctca

SEQ ID NO: 14182 - DNA, 20 bp, Artificial Sequence
  Description of Artificial Sequence: Synthetic oligonucleotide
tgggactcctaggagtccca

SEQ ID NO: 14183 - DNA, 20 bp, Artificial Sequence
  Description of Artificial Sequence: Synthetic oligonucleotide
tgcgactcctaggagtcgca

SEQ ID NO: 14184 - DNA, 20 bp, Artificial Sequence
  Description of Artificial Sequence: Synthetic oligonucleotide
tctgactcctaggagtcaga

SEQ ID NO: 14185 - DNA, 20 bp, Artificial Sequence
  Description of Artificial Sequence: Synthetic oligonucleotide
tcagactcctaggagtctga

SEQ ID NO: 14186 - DNA, 20 bp, Artificial Sequence
  Description of Artificial Sequence: Synthetic oligonucleotide
tcggactcctaggagtccga

SEQ ID NO: 14187 - DNA, 20 bp, Artificial Sequence
  Description of Artificial Sequence: Synthetic oligonucleotide
tccgactcctaggagtcgga

SEQ ID NO: 14188 - DNA, 20 bp, Artificial Sequence
  Description of Artificial Sequence: Synthetic oligonucleotide
tttgactcctaggagtcaaa

SEQ ID NO: 14189 - DNA, 20 bp, Artificial Sequence
  Description of Artificial Sequence: Synthetic oligonucleotide
ttggactcctaggagtccaa

SEQ ID NO: 14190 - DNA, 20 bp, Artificial Sequence
  Description of Artificial Sequence: Synthetic oligonucleotide
aatgactcagctgagtcatt

SEQ ID NO: 14191 - DNA, 20 bp, Artificial Sequence
  Description of Artificial Sequence: Synthetic oligonucleotide
aaagactcagctgagtcttt

SEQ ID NO: 14192 - DNA, 20 bp, Artificial Sequence
  Description of Artificial Sequence: Synthetic oligonucleotide
aaggactcagctgagtcctt

SEQ ID NO: 14193 - DNA, 20 bp, Artificial Sequence
  Description of Artificial Sequence: Synthetic oligonucleotide
agtgactcagctgagtcact

SEQ ID NO: 14194 - DNA, 20 bp, Artificial Sequence
  Description of Artificial Sequence: Synthetic oligonucleotide
agagactcagctgagtctct

SEQ ID NO: 14195 - DNA, 20 bp, Artificial Sequence
  Description of Artificial Sequence: Synthetic oligonucleotide
agggactcagctgagtccct

SEQ ID NO: 14196 - DNA, 20 bp, Artificial Sequence
  Description of Artificial Sequence: Synthetic oligonucleotide
agcgactcagctgagtcgct

SEQ ID NO: 14197 - DNA, 20 bp, Artificial Sequence
  Description of Artificial Sequence: Synthetic oligonucleotide
actgactcagctgagtcagt

SEQ ID NO: 14198 - DNA, 20 bp, Artificial Sequence
  Description of Artificial Sequence: Synthetic oligonucleotide
acagactcagctgagtctgt

SEQ ID NO: 14199 - DNA, 20 bp, Artificial Sequence
  Description of Artificial Sequence: Synthetic oligonucleotide
acggactcagctgagtccgt

SEQ ID NO: 14200 - DNA, 20 bp, Artificial Sequence
  Description of Artificial Sequence: Synthetic oligonucleotide
accgactcagctgagtcggt

SEQ ID NO: 14201 - DNA, 20 bp, Artificial Sequence
  Description of Artificial Sequence: Synthetic oligonucleotide
attgactcagctgagtcaat

SEQ ID NO: 14202 - DNA, 20 bp, Artificial Sequence
  Description of Artificial Sequence: Synthetic oligonucleotide
atggactcagctgagtccat

SEQ ID NO: 14203 - DNA, 20 bp, Artificial Sequence
  Description of Artificial Sequence: Synthetic oligonucleotide
aatgactctcgagagtcatt

SEQ ID NO: 14204 - DNA, 20 bp, Artificial Sequence
  Description of Artificial Sequence: Synthetic oligonucleotide
aaagactctcgagagtcttt

SEQ ID NO: 14205 - DNA, 20 bp, Artificial Sequence
  Description of Artificial Sequence: Synthetic oligonucleotide
aaggactctcgagagtcctt

SEQ ID NO: 14206 - DNA, 20 bp, Artificial Sequence
  Description of Artificial Sequence: Synthetic oligonucleotide
aacgactctcgagagtcgtt

SEQ ID NO: 14207 - DNA, 20 bp, Artificial Sequence
  Description of Artificial Sequence: Synthetic oligonucleotide
agtgactctcgagagtcact

SEQ ID NO: 14208 - DNA, 20 bp, Artificial Sequence
  Description of Artificial Sequence: Synthetic oligonucleotide
agagactctcgagagtctct

SEQ ID NO: 14209 - DNA, 20 bp, Artificial Sequence
  Description of Artificial Sequence: Synthetic oligonucleotide
agggactctcgagagtccct

SEQ ID NO: 14210 - DNA, 20 bp, Artificial Sequence
  Description of Artificial Sequence: Synthetic oligonucleotide
agcgactctcgagagtcgct

SEQ ID NO: 14211 - DNA, 20 bp, Artificial Sequence
  Description of Artificial Sequence: Synthetic oligonucleotide
actgactctcgagagtcagt

SEQ ID NO: 14212 - DNA, 20 bp, Artificial Sequence
  Description of Artificial Sequence: Synthetic oligonucleotide
acagactctcgagagtctgt

SEQ ID NO: 14213 - DNA, 20 bp, Artificial Sequence
  Description of Artificial Sequence: Synthetic oligonucleotide
acggactctcgagagtccgt

SEQ ID NO: 14214 - DNA, 20 bp, Artificial Sequence
  Description of Artificial Sequence: Synthetic oligonucleotide
attgactctcgagagtcaat

SEQ ID NO: 14215 - DNA, 20 bp, Artificial Sequence
  Description of Artificial Sequence: Synthetic oligonucleotide
atggactctcgagagtccat

SEQ ID NO: 14216 - DNA, 20 bp, Artificial Sequence
  Description of Artificial Sequence: Synthetic oligonucleotide
aatgactcacgtgagtcatt

SEQ ID NO: 14217 - DNA, 20 bp, Artificial Sequence
  Description of Artificial Sequence: Synthetic oligonucleotide
aaagactcacgtgagtcttt

SEQ ID NO: 14218 - DNA, 20 bp, Artificial Sequence
  Description of Artificial Sequence: Synthetic oligonucleotide
aaggactcacgtgagtcctt

SEQ ID NO: 14219 - DNA, 20 bp, Artificial Sequence
  Description of Artificial Sequence: Synthetic oligonucleotide
aacgactcacgtgagtcgtt

SEQ ID NO: 14220 - DNA, 20 bp, Artificial Sequence
  Description of Artificial Sequence: Synthetic oligonucleotide
agtgactcacgtgagtcact

SEQ ID NO: 14221 - DNA, 20 bp, Artificial Sequence
  Description of Artificial Sequence: Synthetic oligonucleotide
agagactcacgtgagtctct

SEQ ID NO: 14222 - DNA, 20 bp, Artificial Sequence
  Description of Artificial Sequence: Synthetic oligonucleotide
agggactcacgtgagtccct

SEQ ID NO: 14223 - DNA, 20 bp, Artificial Sequence
  Description of Artificial Sequence: Synthetic oligonucleotide
agcgactcacgtgagtcgct

SEQ ID NO: 14224 - DNA, 20 bp, Artificial Sequence
  Description of Artificial Sequence: Synthetic oligonucleotide
actgactcacgtgagtcagt

SEQ ID NO: 14225 - DNA, 20 bp, Artificial Sequence
  Description of Artificial Sequence: Synthetic oligonucleotide
acagactcacgtgagtctgt

SEQ ID NO: 14226 - DNA, 20 bp, Artificial Sequence
  Description of Artificial Sequence: Synthetic oligonucleotide
acggactcacgtgagtccgt

SEQ ID NO: 14227 - DNA, 20 bp, Artificial Sequence
  Description of Artificial Sequence: Synthetic oligonucleotide
accgactcacgtgagtcggt

SEQ ID NO: 14228 - DNA, 20 bp, Artificial Sequence
  Description of Artificial Sequence: Synthetic oligonucleotide
attgactcacgtgagtcaat

SEQ ID NO: 14229 - DNA, 20 bp, Artificial Sequence
  Description of Artificial Sequence: Synthetic oligonucleotide
atggactcacgtgagtccat

SEQ ID NO: 14230 - DNA, 20 bp, Artificial Sequence
  Description of Artificial Sequence: Synthetic oligonucleotide
aatgactccatggagtcatt

SEQ ID NO: 14231 - DNA, 20 bp, Artificial Sequence
  Description of Artificial Sequence: Synthetic oligonucleotide
aaagactccatggagtcttt

SEQ ID NO: 14232 - DNA, 20 bp, Artificial Sequence
  Description of Artificial Sequence: Synthetic oligonucleotide
aaggactccatggagtcctt

SEQ ID NO: 14233 - DNA, 20 bp, Artificial Sequence
  Description of Artificial Sequence: Synthetic oligonucleotide
aacgactccatggagtcgtt

SEQ ID NO: 14234 - DNA, 20 bp, Artificial Sequence
  Description of Artificial Sequence: Synthetic oligonucleotide
agtgactccatggagtcact

SEQ ID NO: 14235 - DNA, 20 bp, Artificial Sequence
  Description of Artificial Sequence: Synthetic oligonucleotide
agagactccatggagtctct

SEQ ID NO: 14236 - DNA, 20 bp, Artificial Sequence
  Description of Artificial Sequence: Synthetic oligonucleotide
agggactccatggagtccct

SEQ ID NO: 14237 - DNA, 20 bp, Artificial Sequence
  Description of Artificial Sequence: Synthetic oligonucleotide
agcgactccatggagtcgct

SEQ ID NO: 14238 - DNA, 20 bp, Artificial Sequence
  Description of Artificial Sequence: Synthetic oligonucleotide
actgactccatggagtcagt

SEQ ID NO: 14239 - DNA, 20 bp, Artificial Sequence
  Description of Artificial Sequence: Synthetic oligonucleotide
acagactccatggagtctgt

SEQ ID NO: 14240 - DNA, 20 bp, Artificial Sequence
  Description of Artificial Sequence: Synthetic oligonucleotide
acggactccatggagtccgt

SEQ ID NO: 14241 - DNA, 20 bp, Artificial Sequence
  Description of Artificial Sequence: Synthetic oligonucleotide
accgactccatggagtcggt

SEQ ID NO: 14242 - DNA, 20 bp, Artificial Sequence
  Description of Artificial Sequence: Synthetic oligonucleotide
attgactccatggagtcaat

SEQ ID NO: 14243 - DNA, 20 bp, Artificial Sequence
  Description of Artificial Sequence: Synthetic oligonucleotide
atggactccatggagtccat

SEQ ID NO: 14244 - DNA, 20 bp, Artificial Sequence
  Description of Artificial Sequence: Synthetic oligonucleotide
aatgactcgtacgagtcatt

SEQ ID NO: 14245 - DNA, 20 bp, Artificial Sequence
  Description of Artificial Sequence: Synthetic oligonucleotide
aaagactcgtacgagtcttt

SEQ ID NO: 14246 - DNA, 20 bp, Artificial Sequence
  Description of Artificial Sequence: Synthetic oligonucleotide
aaggactcgtacgagtcctt

SEQ ID NO: 14247 - DNA, 20 bp, Artificial Sequence
  Description of Artificial Sequence: Synthetic oligonucleotide
aacgactcgtacgagtcgtt

SEQ ID NO: 14248 - DNA, 20 bp, Artificial Sequence
  Description of Artificial Sequence: Synthetic oligonucleotide
agtgactcgtacgagtcact

SEQ ID NO: 14249 - DNA, 20 bp, Artificial Sequence
  Description of Artificial Sequence: Synthetic oligonucleotide
agagactcgtacgagtctct

SEQ ID NO: 14250 - DNA, 20 bp, Artificial Sequence
  Description of Artificial Sequence: Synthetic oligonucleotide
agggactcgtacgagtccct

SEQ ID NO: 14251 - DNA, 20 bp, Artificial Sequence
  Description of Artificial Sequence: Synthetic oligonucleotide
agcgactcgtacgagtcgct

SEQ ID NO: 14252 - DNA, 20 bp, Artificial Sequence
  Description of Artificial Sequence: Synthetic oligonucleotide
actgactcgtacgagtcagt

SEQ ID NO: 14253 - DNA, 20 bp, Artificial Sequence
  Description of Artificial Sequence: Synthetic oligonucleotide
acagactcgtacgagtctgt

SEQ ID NO: 14254 - DNA, 20 bp, Artificial Sequence
  Description of Artificial Sequence: Synthetic oligonucleotide
acggactcgtacgagtccgt

SEQ ID NO: 14255 - DNA, 20 bp, Artificial Sequence
  Description of Artificial Sequence: Synthetic oligonucleotide
accgactcgtacgagtcggt

SEQ ID NO: 14256 - DNA, 20 bp, Artificial Sequence
  Description of Artificial Sequence: Synthetic oligonucleotide
attgactcgtacgagtcaat

SEQ ID NO: 14257 - DNA, 20 bp, Artificial Sequence
  Description of Artificial Sequence: Synthetic oligonucleotide
atggactcgtacgagtccat

SEQ ID NO: 14258 - DNA, 20 bp, Artificial Sequence
  Description of Artificial Sequence: Synthetic oligonucleotide
aaggactcctaggagtcctt

SEQ ID NO: 14259 - DNA, 20 bp, Artificial Sequence
  Description of Artificial Sequence: Synthetic oligonucleotide
aacgactcctaggagtcgtt

SEQ ID NO: 14260 - DNA, 20 bp, Artificial Sequence
  Description of Artificial Sequence: Synthetic oligonucleotide
agtgactcctaggagtcact

SEQ ID NO: 14261 - DNA, 20 bp, Artificial Sequence
  Description of Artificial Sequence: Synthetic oligonucleotide
agagactcctaggagtctct

SEQ ID NO: 14262 - DNA, 20 bp, Artificial Sequence
  Description of Artificial Sequence: Synthetic oligonucleotide
agggactcctaggagtccct

SEQ ID NO: 14263 - DNA, 20 bp, Artificial Sequence
  Description of Artificial Sequence: Synthetic oligonucleotide
agcgactcctaggagtcgct

SEQ ID NO: 14264 - DNA, 20 bp, Artificial Sequence
  Description of Artificial Sequence: Synthetic oligonucleotide
actgactcctaggagtcagt

SEQ ID NO: 14265 - DNA, 20 bp, Artificial Sequence
  Description of Artificial Sequence: Synthetic oligonucleotide
acagactcctaggagtctgt

SEQ ID NO: 14266 - DNA, 20 bp, Artificial Sequence
  Description of Artificial Sequence: Synthetic oligonucleotide
acggactcctaggagtccgt

SEQ ID NO: 14267 - DNA, 20 bp, Artificial Sequence
  Description of Artificial Sequence: Synthetic oligonucleotide
accgactcctaggagtcggt

SEQ ID NO: 14268 - DNA, 20 bp, Artificial Sequence
  Description of Artificial Sequence: Synthetic oligonucleotide
atggactcctaggagtccat

SEQ ID NO: 14269 - DNA, 20 bp, Artificial Sequence
  Description of Artificial Sequence: Synthetic oligonucleotide
gatgactcagctgagtcatc

SEQ ID NO: 14270 - DNA, 20 bp, Artificial Sequence
  Description of Artificial Sequence: Synthetic oligonucleotide
gaagactcagctgagtcttc

SEQ ID NO: 14271 - DNA, 20 bp, Artificial Sequence
  Description of Artificial Sequence: Synthetic oligonucleotide
gaggactcagctgagtcctc

SEQ ID NO: 14272 - DNA, 20 bp, Artificial Sequence
  Description of Artificial Sequence: Synthetic oligonucleotide
ggtgactcagctgagtcacc

SEQ ID NO: 14273 - DNA, 20 bp, Artificial Sequence
  Description of Artificial Sequence: Synthetic oligonucleotide
ggagactcagctgagtctcc

SEQ ID NO: 14274 - DNA, 20 bp, Artificial Sequence
  Description of Artificial Sequence: Synthetic oligonucleotide
ggcgactcagctgagtcgcc

SEQ ID NO: 14275 - DNA, 20 bp, Artificial Sequence
  Description of Artificial Sequence: Synthetic oligonucleotide
gctgactcagctgagtcagc

SEQ ID NO: 14276 - DNA, 20 bp, Artificial Sequence
  Description of Artificial Sequence: Synthetic oligonucleotide
gcagactcagctgagtctgc

SEQ ID NO: 14277 - DNA, 20 bp, Artificial Sequence
  Description of Artificial Sequence: Synthetic oligonucleotide
gcggactcagctgagtccgc

SEQ ID NO: 14278 - DNA, 20 bp, Artificial Sequence
  Description of Artificial Sequence: Synthetic oligonucleotide
gccgactcagctgagtcggc

SEQ ID NO: 14279 - DNA, 20 bp, Artificial Sequence
  Description of Artificial Sequence: Synthetic oligonucleotide
gttgactcagctgagtcaac

SEQ ID NO: 14280 - DNA, 20 bp, Artificial Sequence
  Description of Artificial Sequence: Synthetic oligonucleotide
gtagactcagctgagtctac

SEQ ID NO: 14281 - DNA, 20 bp, Artificial Sequence
  Description of Artificial Sequence: Synthetic oligonucleotide
gtggactcagctgagtccac

SEQ ID NO: 14282 - DNA, 20 bp, Artificial Sequence
  Description of Artificial Sequence: Synthetic oligonucleotide
gatgactctcgagagtcatc

SEQ ID NO: 14283 - DNA, 20 bp, Artificial Sequence
  Description of Artificial Sequence: Synthetic oligonucleotide
gaagactctcgagagtcttc

SEQ ID NO: 14284 - DNA, 20 bp, Artificial Sequence
  Description of Artificial Sequence: Synthetic oligonucleotide
gaggactctcgagagtcctc

SEQ ID NO: 14285 - DNA, 20 bp, Artificial Sequence
  Description of Artificial Sequence: Synthetic oligonucleotide
gacgactctcgagagtcgtc

SEQ ID NO: 14286 - DNA, 20 bp, Artificial Sequence
  Description of Artificial Sequence: Synthetic oligonucleotide
ggtgactctcgagagtcacc

SEQ ID NO: 14287 - DNA, 20 bp, Artificial Sequence
  Description of Artificial Sequence: Synthetic oligonucleotide
ggagactctcgagagtctcc

SEQ ID NO: 14288 - DNA, 20 bp, Artificial Sequence
  Description of Artificial Sequence: Synthetic oligonucleotide
ggcgactctcgagagtcgcc

SEQ ID NO: 14289 - DNA, 20 bp, Artificial Sequence
  Description of Artificial Sequence: Synthetic oligonucleotide
gctgactctcgagagtcagc

SEQ ID NO: 14290 - DNA, 20 bp, Artificial Sequence
  Description of Artificial Sequence: Synthetic oligonucleotide
gcagactctcgagagtctgc

SEQ ID NO: 14291 - DNA, 20 bp, Artificial Sequence
  Description of Artificial Sequence: Synthetic oligonucleotide
gcggactctcgagagtccgc

SEQ ID NO: 14292 - DNA, 20 bp, Artificial Sequence
  Description of Artificial Sequence: Synthetic oligonucleotide
gttgactctcgagagtcaac

SEQ ID NO: 14293 - DNA, 20 bp, Artificial Sequence
  Description of Artificial Sequence: Synthetic oligonucleotide
gtagactctcgagagtctac

SEQ ID NO: 14294 - DNA, 20 bp, Artificial Sequence
  Description of Artificial Sequence: Synthetic oligonucleotide
gtggactctcgagagtccac

SEQ ID NO: 14295 - DNA, 20 bp, Artificial Sequence
  Description of Artificial Sequence: Synthetic oligonucleotide
gatgactcacgtgagtcatc

SEQ ID NO: 14296 - DNA, 20 bp, Artificial Sequence
  Description of Artificial Sequence: Synthetic oligonucleotide
gaagactcacgtgagtcttc

SEQ ID NO: 14297 - DNA, 20 bp, Artificial Sequence
  Description of Artificial Sequence: Synthetic oligonucleotide
gaggactcacgtgagtcctc

SEQ ID NO: 14298 - DNA, 20 bp, Artificial Sequence
  Description of Artificial Sequence: Synthetic oligonucleotide
gacgactcacgtgagtcgtc

SEQ ID NO: 14299 - DNA, 20 bp, Artificial Sequence
  Description of Artificial Sequence: Synthetic oligonucleotide
ggtgactcacgtgagtcacc

SEQ ID NO: 14300 - DNA, 20 bp, Artificial Sequence
  Description of Artificial Sequence: Synthetic oligonucleotide
ggagactcacgtgagtctcc

SEQ ID NO: 14301 - DNA, 20 bp, Artificial Sequence
  Description of Artificial Sequence: Synthetic oligonucleotide
ggcgactcacgtgagtcgcc

SEQ ID NO: 14302 - DNA, 20 bp, Artificial Sequence
  Description of Artificial Sequence: Synthetic oligonucleotide
gctgactcacgtgagtcagc

SEQ ID NO: 14303 - DNA, 20 bp, Artificial Sequence
  Description of Artificial Sequence: Synthetic oligonucleotide
gcagactcacgtgagtctgc

SEQ ID NO: 14304 - DNA, 20 bp, Artificial Sequence
  Description of Artificial Sequence: Synthetic oligonucleotide
gcggactcacgtgagtccgc

SEQ ID NO: 14305 - DNA, 20 bp, Artificial Sequence
  Description of Artificial Sequence: Synthetic oligonucleotide
gccgactcacgtgagtcggc

SEQ ID NO: 14306 - DNA, 20 bp, Artificial Sequence
  Description of Artificial Sequence: Synthetic oligonucleotide
gttgactcacgtgagtcaac

SEQ ID NO: 14307 - DNA, 20 bp, Artificial Sequence
  Description of Artificial Sequence: Synthetic oligonucleotide
gtagactcacgtgagtctac

SEQ ID NO: 14308 - DNA, 20 bp, Artificial Sequence
  Description of Artificial Sequence: Synthetic oligonucleotide
gtggactcacgtgagtccac

SEQ ID NO: 14309 - DNA, 20 bp, Artificial Sequence
  Description of Artificial Sequence: Synthetic oligonucleotide
gatgactccatggagtcatc

SEQ ID NO: 14310 - DNA, 20 bp, Artificial Sequence
  Description of Artificial Sequence: Synthetic oligonucleotide
gaagactccatggagtcttc

SEQ ID NO: 14311 - DNA, 20 bp, Artificial Sequence
  Description of Artificial Sequence: Synthetic oligonucleotide
gaggactccatggagtcctc

SEQ ID NO: 14312 - DNA, 20 bp, Artificial Sequence
  Description of Artificial Sequence: Synthetic oligonucleotide
gacgactccatggagtcgtc

SEQ ID NO: 14313 - DNA, 20 bp, Artificial Sequence
  Description of Artificial Sequence: Synthetic oligonucleotide
ggtgactccatggagtcacc

SEQ ID NO: 14314 - DNA, 20 bp, Artificial Sequence
  Description of Artificial Sequence: Synthetic oligonucleotide
ggagactccatggagtctcc

SEQ ID NO: 14315 - DNA, 20 bp, Artificial Sequence
  Description of Artificial Sequence: Synthetic oligonucleotide
ggcgactccatggagtcgcc

SEQ ID NO: 14316 - DNA, 20 bp, Artificial Sequence
  Description of Artificial Sequence: Synthetic oligonucleotide
gctgactccatggagtcagc

SEQ ID NO: 14317 - DNA, 20 bp, Artificial Sequence
  Description of Artificial Sequence: Synthetic oligonucleotide
gcagactccatggagtctgc

SEQ ID NO: 14318 - DNA, 20 bp, Artificial Sequence
  Description of Artificial Sequence: Synthetic oligonucleotide
gcggactccatggagtccgc

SEQ ID NO: 14319 - DNA, 20 bp, Artificial Sequence
  Description of Artificial Sequence: Synthetic oligonucleotide
gccgactccatggagtcggc

SEQ ID NO: 14320 - DNA, 20 bp, Artificial Sequence
  Description of Artificial Sequence: Synthetic oligonucleotide
gttgactccatggagtcaac

SEQ ID NO: 14321 - DNA, 20 bp, Artificial Sequence
  Description of Artificial Sequence: Synthetic oligonucleotide
gtagactccatggagtctac

SEQ ID NO: 14322 - DNA, 20 bp, Artificial Sequence
  Description of Artificial Sequence: Synthetic oligonucleotide
gtggactccatggagtccac

SEQ ID NO: 14323 - DNA, 20 bp, Artificial Sequence
  Description of Artificial Sequence: Synthetic oligonucleotide
gatgactcgtacgagtcatc

SEQ ID NO: 14324 - DNA, 20 bp, Artificial Sequence
  Description of Artificial Sequence: Synthetic oligonucleotide
gaagactcgtacgagtcttc

SEQ ID NO: 14325 - DNA, 20 bp, Artificial Sequence
  Description of Artificial Sequence: Synthetic oligonucleotide
gaggactcgtacgagtcctc

SEQ ID NO: 14326 - DNA, 20 bp, Artificial Sequence
  Description of Artificial Sequence: Synthetic oligonucleotide
gacgactcgtacgagtcgtc

SEQ ID NO: 14327 - DNA, 20 bp, Artificial Sequence
  Description of Artificial Sequence: Synthetic oligonucleotide
ggtgactcgtacgagtcacc

SEQ ID NO: 14328 - DNA, 20 bp, Artificial Sequence
  Description of Artificial Sequence: Synthetic oligonucleotide
ggagactcgtacgagtctcc

SEQ ID NO: 14329 - DNA, 20 bp, Artificial Sequence
  Description of Artificial Sequence: Synthetic oligonucleotide
ggcgactcgtacgagtcgcc

SEQ ID NO: 14330 - DNA, 20 bp, Artificial Sequence
  Description of Artificial Sequence: Synthetic oligonucleotide
gctgactcgtacgagtcagc

SEQ ID NO: 14331 - DNA, 20 bp, Artificial Sequence
  Description of Artificial Sequence: Synthetic oligonucleotide
gcagactcgtacgagtctgc

SEQ ID NO: 14332 - DNA, 20 bp, Artificial Sequence
  Description of Artificial Sequence: Synthetic oligonucleotide
gcggactcgtacgagtccgc

SEQ ID NO: 14333 - DNA, 20 bp, Artificial Sequence
  Description of Artificial Sequence: Synthetic oligonucleotide
gccgactcgtacgagtcggc

SEQ ID NO: 14334 - DNA, 20 bp, Artificial Sequence
  Description of Artificial Sequence: Synthetic oligonucleotide
gttgactcgtacgagtcaac

SEQ ID NO: 14335 - DNA, 20 bp, Artificial Sequence
  Description of Artificial Sequence: Synthetic oligonucleotide
gtagactcgtacgagtctac

SEQ ID NO: 14336 - DNA, 20 bp, Artificial Sequence
  Description of Artificial Sequence: Synthetic oligonucleotide
gtggactcgtacgagtccac

SEQ ID NO: 14337 - DNA, 20 bp, Artificial Sequence
  Description of Artificial Sequence: Synthetic oligonucleotide
gatgactcctaggagtcatc

SEQ ID NO: 14338 - DNA, 20 bp, Artificial Sequence
  Description of Artificial Sequence: Synthetic oligonucleotide
gaagactcctaggagtcttc

SEQ ID NO: 14339 - DNA, 20 bp, Artificial Sequence
  Description of Artificial Sequence: Synthetic oligonucleotide
gaggactcctaggagtcctc

SEQ ID NO: 14340 - DNA, 20 bp, Artificial Sequence
  Description of Artificial Sequence: Synthetic oligonucleotide
gacgactcctaggagtcgtc

SEQ ID NO: 14341 - DNA, 20 bp, Artificial Sequence
  Description of Artificial Sequence: Synthetic oligonucleotide
ggtgactcctaggagtcacc

SEQ ID NO: 14342 - DNA, 20 bp, Artificial Sequence
  Description of Artificial Sequence: Synthetic oligonucleotide
ggagactcctaggagtctcc

SEQ ID NO: 14343 - DNA, 20 bp, Artificial Sequence
  Description of Artificial Sequence: Synthetic oligonucleotide
ggcgactcctaggagtcgcc

SEQ ID NO: 14344 - DNA, 20 bp, Artificial Sequence
  Description of Artificial Sequence: Synthetic oligonucleotide
gctgactcctaggagtcagc

SEQ ID NO: 14345 - DNA, 20 bp, Artificial Sequence
  Description of Artificial Sequence: Synthetic oligonucleotide
gcagactcctaggagtctgc

SEQ ID NO: 14346 - DNA, 20 bp, Artificial Sequence
  Description of Artificial Sequence: Synthetic oligonucleotide
gcggactcctaggagtccgc

SEQ ID NO: 14347 - DNA, 20 bp, Artificial Sequence
  Description of Artificial Sequence: Synthetic oligonucleotide
gccgactcctaggagtcggc

SEQ ID NO: 14348 - DNA, 20 bp, Artificial Sequence
  Description of Artificial Sequence: Synthetic oligonucleotide
gttgactcctaggagtcaac

SEQ ID NO: 14349 - DNA, 20 bp, Artificial Sequence
  Description of Artificial Sequence: Synthetic oligonucleotide
gtagactcctaggagtctac

SEQ ID NO: 14350 - DNA, 20 bp, Artificial Sequence
  Description of Artificial Sequence: Synthetic oligonucleotide
gtggactcctaggagtccac

SEQ ID NO: 14351 - DNA, 20 bp, Artificial Sequence
  Description of Artificial Sequence: Synthetic oligonucleotide
caagactcagctgagtcttg

SEQ ID NO: 14352 - DNA, 20 bp, Artificial Sequence
  Description of Artificial Sequence: Synthetic oligonucleotide
caggactcagctgagtcctg

SEQ ID NO: 14353 - DNA, 20 bp, Artificial Sequence
  Description of Artificial Sequence: Synthetic oligonucleotide
cgtgactcagctgagtcacg

SEQ ID NO: 14354 - DNA, 20 bp, Artificial Sequence
  Description of Artificial Sequence: Synthetic oligonucleotide
cgagactcagctgagtctcg

SEQ ID NO: 14355 - DNA, 20 bp, Artificial Sequence
  Description of Artificial Sequence: Synthetic oligonucleotide
cgggactcagctgagtcccg

SEQ ID NO: 14356 - DNA, 20 bp, Artificial Sequence
  Description of Artificial Sequence: Synthetic oligonucleotide
cgcgactcagctgagtcgcg

SEQ ID NO: 14357 - DNA, 20 bp, Artificial Sequence
  Description of Artificial Sequence: Synthetic oligonucleotide
cctgactcagctgagtcagg

SEQ ID NO: 14358 - DNA, 20 bp, Artificial Sequence
  Description of Artificial Sequence: Synthetic oligonucleotide
ccagactcagctgagtctgg

SEQ ID NO: 14359 - DNA, 20 bp, Artificial Sequence
  Description of Artificial Sequence: Synthetic oligonucleotide
ccggactcagctgagtccgg

SEQ ID NO: 14360 - DNA, 20 bp, Artificial Sequence
  Description of Artificial Sequence: Synthetic oligonucleotide
cccgactcagctgagtcggg

SEQ ID NO: 14361 - DNA, 20 bp, Artificial Sequence
  Description of Artificial Sequence: Synthetic oligonucleotide
cttgactcagctgagtcaag

SEQ ID NO: 14362 - DNA, 20 bp, Artificial Sequence
  Description of Artificial Sequence: Synthetic oligonucleotide
ctagactcagctgagtctag

SEQ ID NO: 14363 - DNA, 20 bp, Artificial Sequence
  Description of Artificial Sequence: Synthetic oligonucleotide
ctggactcagctgagtccag

SEQ ID NO: 14364 - DNA, 20 bp, Artificial Sequence
  Description of Artificial Sequence: Synthetic oligonucleotide
caagactctcgagagtcttg

SEQ ID NO: 14365 - DNA, 20 bp, Artificial Sequence
  Description of Artificial Sequence: Synthetic oligonucleotide
caggactctcgagagtcctg

SEQ ID NO: 14366 - DNA, 20 bp, Artificial Sequence
  Description of Artificial Sequence: Synthetic oligonucleotide
cacgactctcgagagtcgtg

SEQ ID NO: 14367 - DNA, 20 bp, Artificial Sequence
  Description of Artificial Sequence: Synthetic oligonucleotide
cgtgactctcgagagtcacg

SEQ ID NO: 14368 - DNA, 20 bp, Artificial Sequence
  Description of Artificial Sequence: Synthetic oligonucleotide
cgagactctcgagagtctcg

SEQ ID NO: 14369 - DNA, 20 bp, Artificial Sequence
  Description of Artificial Sequence: Synthetic oligonucleotide
cgggactctcgagagtcccg

SEQ ID NO: 14370 - DNA, 20 bp, Artificial Sequence
  Description of Artificial Sequence: Synthetic oligonucleotide
cgcgactctcgagagtcgcg

SEQ ID NO: 14371 - DNA, 20 bp, Artificial Sequence
  Description of Artificial Sequence: Synthetic oligonucleotide
cctgactctcgagagtcagg

SEQ ID NO: 14372 - DNA, 20 bp, Artificial Sequence
  Description of Artificial Sequence: Synthetic oligonucleotide
ccagactctcgagagtctgg

SEQ ID NO: 14373 - DNA, 20 bp, Artificial Sequence
  Description of Artificial Sequence: Synthetic oligonucleotide
ccggactctcgagagtccgg

SEQ ID NO: 14374 - DNA, 20 bp, Artificial Sequence
  Description of Artificial Sequence: Synthetic oligonucleotide
cttgactctcgagagtcaag

SEQ ID NO: 14375 - DNA, 20 bp, Artificial Sequence
  Description of Artificial Sequence: Synthetic oligonucleotide
ctagactctcgagagtctag

SEQ ID NO: 14376 - DNA, 20 bp, Artificial Sequence
  Description of Artificial Sequence: Synthetic oligonucleotide
ctggactctcgagagtccag

SEQ ID NO: 14377 - DNA, 20 bp, Artificial Sequence
  Description of Artificial Sequence: Synthetic oligonucleotide
caagactcacgtgagtcttg

SEQ ID NO: 14378 - DNA, 20 bp, Artificial Sequence
  Description of Artificial Sequence: Synthetic oligonucleotide
caggactcacgtgagtcctg

SEQ ID NO: 14379 - DNA, 20 bp, Artificial Sequence
  Description of Artificial Sequence: Synthetic oligonucleotide
cacgactcacgtgagtcgtg

SEQ ID NO: 14380 - DNA, 20 bp, Artificial Sequence
  Description of Artificial Sequence: Synthetic oligonucleotide
cgtgactcacgtgagtcacg

SEQ ID NO: 14381 - DNA, 20 bp, Artificial Sequence
  Description of Artificial Sequence: Synthetic oligonucleotide
cgagactcacgtgagtctcg

SEQ ID NO: 14382 - DNA, 20 bp, Artificial Sequence
  Description of Artificial Sequence: Synthetic oligonucleotide
cgggactcacgtgagtcccg

SEQ ID NO: 14383 - DNA, 20 bp, Artificial Sequence
  Description of Artificial Sequence: Synthetic oligonucleotide
cgcgactcacgtgagtcgcg

SEQ ID NO: 14384 - DNA, 20 bp, Artificial Sequence
  Description of Artificial Sequence: Synthetic oligonucleotide
cctgactcacgtgagtcagg

SEQ ID NO: 14385 - DNA, 20 bp, Artificial Sequence
  Description of Artificial Sequence: Synthetic oligonucleotide
ccagactcacgtgagtctgg

SEQ ID NO: 14386 - DNA, 20 bp, Artificial Sequence
  Description of Artificial Sequence: Synthetic oligonucleotide
ccggactcacgtgagtccgg

SEQ ID NO: 14387 - DNA, 20 bp, Artificial Sequence
  Description of Artificial Sequence: Synthetic oligonucleotide
cccgactcacgtgagtcggg

SEQ ID NO: 14388 - DNA, 20 bp, Artificial Sequence
  Description of Artificial Sequence: Synthetic oligonucleotide
cttgactcacgtgagtcaag

SEQ ID NO: 14389 - DNA, 20 bp, Artificial Sequence
  Description of Artificial Sequence: Synthetic oligonucleotide
ctagactcacgtgagtctag

SEQ ID NO: 14390 - DNA, 20 bp, Artificial Sequence
  Description of Artificial Sequence: Synthetic oligonucleotide
ctggactcacgtgagtccag

SEQ ID NO: 14391 - DNA, 20 bp, Artificial Sequence
  Description of Artificial Sequence: Synthetic oligonucleotide
caagactccatggagtcttg

SEQ ID NO: 14392 - DNA, 20 bp, Artificial Sequence
  Description of Artificial Sequence: Synthetic oligonucleotide
caggactccatggagtcctg

SEQ ID NO: 14393 - DNA, 20 bp, Artificial Sequence
  Description of Artificial Sequence: Synthetic oligonucleotide
cacgactccatggagtcgtg

SEQ ID NO: 14394 - DNA, 20 bp, Artificial Sequence
  Description of Artificial Sequence: Synthetic oligonucleotide
cgtgactccatggagtcacg

SEQ ID NO: 14395 - DNA, 20 bp, Artificial Sequence
  Description of Artificial Sequence: Synthetic oligonucleotide
cgagactccatggagtctcg

SEQ ID NO: 14396 - DNA, 20 bp, Artificial Sequence
  Description of Artificial Sequence: Synthetic oligonucleotide
cgggactccatggagtcccg

SEQ ID NO: 14397 - DNA, 20 bp, Artificial Sequence
  Description of Artificial Sequence: Synthetic oligonucleotide
cgcgactccatggagtcgcg

SEQ ID NO: 14398 - DNA, 20 bp, Artificial Sequence
  Description of Artificial Sequence: Synthetic oligonucleotide
cctgactccatggagtcagg

SEQ ID NO: 14399 - DNA, 20 bp, Artificial Sequence
  Description of Artificial Sequence: Synthetic oligonucleotide
ccagactccatggagtctgg

SEQ ID NO: 14400 - DNA, 20 bp, Artificial Sequence
  Description of Artificial Sequence: Synthetic oligonucleotide
ccggactccatggagtccgg

SEQ ID NO: 14401 - DNA, 20 bp, Artificial Sequence
  Description of Artificial Sequence: Synthetic oligonucleotide
cccgactccatggagtcggg

SEQ ID NO: 14402 - DNA, 20 bp, Artificial Sequence
  Description of Artificial Sequence: Synthetic oligonucleotide
cttgactccatggagtcaag

SEQ ID NO: 14403 - DNA, 20 bp, Artificial Sequence
  Description of Artificial Sequence: Synthetic oligonucleotide
ctagactccatggagtctag

SEQ ID NO: 14404 - DNA, 20 bp, Artificial Sequence
  Description of Artificial Sequence: Synthetic oligonucleotide
ctggactccatggagtccag

SEQ ID NO: 14405 - DNA, 20 bp, Artificial Sequence
  Description of Artificial Sequence: Synthetic oligonucleotide
caagactcgtacgagtcttg

SEQ ID NO: 14406 - DNA, 20 bp, Artificial Sequence
  Description of Artificial Sequence: Synthetic oligonucleotide
caggactcgtacgagtcctg

SEQ ID NO: 14407 - DNA, 20 bp, Artificial Sequence
  Description of Artificial Sequence: Synthetic oligonucleotide
cacgactcgtacgagtcgtg

SEQ ID NO: 14408 - DNA, 20 bp, Artificial Sequence
  Description of Artificial Sequence: Synthetic oligonucleotide
cgtgactcgtacgagtcacg

SEQ ID NO: 14409 - DNA, 20 bp, Artificial Sequence
  Description of Artificial Sequence: Synthetic oligonucleotide
cgagactcgtacgagtctcg

SEQ ID NO: 14410 - DNA, 20 bp, Artificial Sequence
  Description of Artificial Sequence: Synthetic oligonucleotide
cgggactcgtacgagtcccg

SEQ ID NO: 14411 - DNA, 20 bp, Artificial Sequence
  Description of Artificial Sequence: Synthetic oligonucleotide
cgcgactcgtacgagtcgcg

SEQ ID NO: 14412 - DNA, 20 bp, Artificial Sequence
  Description of Artificial Sequence: Synthetic oligonucleotide
cctgactcgtacgagtcagg

SEQ ID NO: 14413 - DNA, 20 bp, Artificial Sequence
  Description of Artificial Sequence: Synthetic oligonucleotide
ccagactcgtacgagtctgg

SEQ ID NO: 14414 - DNA, 20 bp, Artificial Sequence
  Description of Artificial Sequence: Synthetic oligonucleotide
ccggactcgtacgagtccgg

SEQ ID NO: 14415 - DNA, 20 bp, Artificial Sequence
  Description of Artificial Sequence: Synthetic oligonucleotide
cccgactcgtacgagtcggg

SEQ ID NO: 14416 - DNA, 20 bp, Artificial Sequence
  Description of Artificial Sequence: Synthetic oligonucleotide
cttgactcgtacgagtcaag

SEQ ID NO: 14417 - DNA, 20 bp, Artificial Sequence
  Description of Artificial Sequence: Synthetic oligonucleotide
ctagactcgtacgagtctag

SEQ ID NO: 14418 - DNA, 20 bp, Artificial Sequence
  Description of Artificial Sequence: Synthetic oligonucleotide
ctggactcgtacgagtccag

SEQ ID NO: 14419 - DNA, 20 bp, Artificial Sequence
  Description of Artificial Sequence: Synthetic oligonucleotide
caagactcctaggagtcttg

SEQ ID NO: 14420 - DNA, 20 bp, Artificial Sequence
  Description of Artificial Sequence: Synthetic oligonucleotide
caggactcctaggagtcctg

SEQ ID NO: 14421 - DNA, 20 bp, Artificial Sequence
  Description of Artificial Sequence: Synthetic oligonucleotide
cacgactcctaggagtcgtg

SEQ ID NO: 14422 - DNA, 20 bp, Artificial Sequence
  Description of Artificial Sequence: Synthetic oligonucleotide
cgtgactcctaggagtcacg

SEQ ID NO: 14423 - DNA, 20 bp, Artificial Sequence
  Description of Artificial Sequence: Synthetic oligonucleotide
cgagactcctaggagtctcg

SEQ ID NO: 14424 - DNA, 20 bp, Artificial Sequence
  Description of Artificial Sequence: Synthetic oligonucleotide
cgggactcctaggagtcccg

SEQ ID NO: 14425 - DNA, 20 bp, Artificial Sequence
  Description of Artificial Sequence: Synthetic oligonucleotide
cgcgactcctaggagtcgcg

SEQ ID NO: 14426 - DNA, 20 bp, Artificial Sequence
  Description of Artificial Sequence: Synthetic oligonucleotide
cctgactcctaggagtcagg

SEQ ID NO: 14427 - DNA, 20 bp, Artificial Sequence
  Description of Artificial Sequence: Synthetic oligonucleotide
ccagactcctaggagtctgg

SEQ ID NO: 14428 - DNA, 20 bp, Artificial Sequence
  Description of Artificial Sequence: Synthetic oligonucleotide
ccggactcctaggagtccgg

SEQ ID NO: 14429 - DNA, 20 bp, Artificial Sequence
  Description of Artificial Sequence: Synthetic oligonucleotide
cccgactcctaggagtcggg

SEQ ID NO: 14430 - DNA, 20 bp, Artificial Sequence
  Description of Artificial Sequence: Synthetic oligonucleotide
cttgactcctaggagtcaag

SEQ ID NO: 14431 - DNA, 20 bp, Artificial Sequence
  Description of Artificial Sequence: Synthetic oligonucleotide
ctagactcctaggagtctag

SEQ ID NO: 14432 - DNA, 20 bp, Artificial Sequence
  Description of Artificial Sequence: Synthetic oligonucleotide
ctggactcctaggagtccag

SEQ ID NO: 14433 - DNA, 18 bp, Artificial Sequence
  Description of Artificial Sequence: Synthetic oligonucleotide
atgactccgcggagtcat

SEQ ID NO: 14434 - DNA, 18 bp, Artificial Sequence
  Description of Artificial Sequence: Synthetic oligonucleotide
aagactccgcggagtctt

SEQ ID NO: 14435 - DNA, 18 bp, Artificial Sequence
  Description of Artificial Sequence: Synthetic oligonucleotide
aggactccgcggagtcct

SEQ ID NO: 14436 - DNA, 18 bp, Artificial Sequence
  Description of Artificial Sequence: Synthetic oligonucleotide
acgactccgcggagtcgt

SEQ ID NO: 14437 - DNA, 18 bp, Artificial Sequence
  Description of Artificial Sequence: Synthetic oligonucleotide
gtgactccgcggagtcac

SEQ ID NO: 14438 - DNA, 18 bp, Artificial Sequence
  Description of Artificial Sequence: Synthetic oligonucleotide
gagactccgcggagtctc

SEQ ID NO: 14439 - DNA, 18 bp, Artificial Sequence
  Description of Artificial Sequence: Synthetic oligonucleotide
gggactccgcggagtccc

SEQ ID NO: 14440 - DNA, 18 bp, Artificial Sequence
  Description of Artificial Sequence: Synthetic oligonucleotide
gcgactccgcggagtcgc

SEQ ID NO: 14441 - DNA, 18 bp, Artificial Sequence
  Description of Artificial Sequence: Synthetic oligonucleotide
ctgactccgcggagtcag

SEQ ID NO: 14442 - DNA, 18 bp, Artificial Sequence
  Description of Artificial Sequence: Synthetic oligonucleotide
cagactccgcggagtctg

SEQ ID NO: 14443 - DNA, 18 bp, Artificial Sequence
  Description of Artificial Sequence: Synthetic oligonucleotide
cggactccgcggagtccg

SEQ ID NO: 14444 - DNA, 18 bp, Artificial Sequence
  Description of Artificial Sequence: Synthetic oligonucleotide
ccgactccgcggagtcgg

SEQ ID NO: 14445 - DNA, 18 bp, Artificial Sequence
  Description of Artificial Sequence: Synthetic oligonucleotide
ttgactccgcggagtcaa

SEQ ID NO: 14446 - DNA, 18 bp, Artificial Sequence
  Description of Artificial Sequence: Synthetic oligonucleotide
tagactccgcggagtcta

SEQ ID NO: 14447 - DNA, 18 bp, Artificial Sequence
  Description of Artificial Sequence: Synthetic oligonucleotide
tggactccgcggagtcca

SEQ ID NO: 14448 - DNA, 18 bp, Artificial Sequence
  Description of Artificial Sequence: Synthetic oligonucleotide
atgactcccgggagtcat

SEQ ID NO: 14449 - DNA, 18 bp, Artificial Sequence
  Description of Artificial Sequence: Synthetic oligonucleotide
aagactcccgggagtctt

SEQ ID NO: 14450 - DNA, 18 bp, Artificial Sequence
  Description of Artificial Sequence: Synthetic oligonucleotide
aggactcccgggagtcct

SEQ ID NO: 14451 - DNA, 18 bp, Artificial Sequence
  Description of Artificial Sequence: Synthetic oligonucleotide
acgactcccgggagtcgt

SEQ ID NO: 14452 - DNA, 18 bp, Artificial Sequence
  Description of Artificial Sequence: Synthetic oligonucleotide
gtgactcccgggagtcac

SEQ ID NO: 14453 - DNA, 18 bp, Artificial Sequence
  Description of Artificial Sequence: Synthetic oligonucleotide
gagactcccgggagtctc

SEQ ID NO: 14454 - DNA, 18 bp, Artificial Sequence
  Description of Artificial Sequence: Synthetic oligonucleotide
gggactcccgggagtccc

SEQ ID NO: 14455 - DNA, 18 bp, Artificial Sequence
  Description of Artificial Sequence: Synthetic oligonucleotide
gcgactcccgggagtcgc

SEQ ID NO: 14456 - DNA, 18 bp, Artificial Sequence
  Description of Artificial Sequence: Synthetic oligonucleotide
ctgactcccgggagtcag

SEQ ID NO: 14457 - DNA, 18 bp, Artificial Sequence
  Description of Artificial Sequence: Synthetic oligonucleotide
cagactcccgggagtctg

SEQ ID NO: 14458 - DNA, 18 bp, Artificial Sequence
  Description of Artificial Sequence: Synthetic oligonucleotide
cggactcccgggagtccg

SEQ ID NO: 14459 - DNA, 18 bp, Artificial Sequence
  Description of Artificial Sequence: Synthetic oligonucleotide
ccgactcccgggagtcgg

SEQ ID NO: 14460 - DNA, 18 bp, Artificial Sequence
  Description of Artificial Sequence: Synthetic oligonucleotide
ttgactcccgggagtcaa

SEQ ID NO: 14461 - DNA, 18 bp, Artificial Sequence
  Description of Artificial Sequence: Synthetic oligonucleotide
tagactcccgggagtcta

SEQ ID NO: 14462 - DNA, 18 bp, Artificial Sequence
  Description of Artificial Sequence: Synthetic oligonucleotide
tggactcccgggagtcca

SEQ ID NO: 14463 - DNA, 18 bp, Artificial Sequence
  Description of Artificial Sequence: Synthetic oligonucleotide
atgactcggccgagtcat

SEQ ID NO: 14464 - DNA, 18 bp, Artificial Sequence
  Description of Artificial Sequence: Synthetic oligonucleotide
aagactcggccgagtctt

SEQ ID NO: 14465 - DNA, 18 bp, Artificial Sequence
  Description of Artificial Sequence: Synthetic oligonucleotide
aggactcggccgagtcct

SEQ ID NO: 14466 - DNA, 18 bp, Artificial Sequence
  Description of Artificial Sequence: Synthetic oligonucleotide
acgactcggccgagtcgt

SEQ ID NO: 14467 - DNA, 18 bp, Artificial Sequence
  Description of Artificial Sequence: Synthetic oligonucleotide
gtgactcggccgagtcac

SEQ ID NO: 14468 - DNA, 18 bp, Artificial Sequence
  Description of Artificial Sequence: Synthetic oligonucleotide
gagactcggccgagtctc

SEQ ID NO: 14469 - DNA, 18 bp, Artificial Sequence
  Description of Artificial Sequence: Synthetic oligonucleotide
gggactcggccgagtccc

SEQ ID NO: 14470 - DNA, 18 bp, Artificial Sequence
  Description of Artificial Sequence: Synthetic oligonucleotide
gcgactcggccgagtcgc

SEQ ID NO: 14471 - DNA, 18 bp, Artificial Sequence
  Description of Artificial Sequence: Synthetic oligonucleotide
ctgactcggccgagtcag

SEQ ID NO: 14472 - DNA, 18 bp, Artificial Sequence
  Description of Artificial Sequence: Synthetic oligonucleotide
cagactcggccgagtctg

SEQ ID NO: 14473 - DNA, 18 bp, Artificial Sequence
  Description of Artificial Sequence: Synthetic oligonucleotide
cggactcggccgagtccg

SEQ ID NO: 14474 - DNA, 18 bp, Artificial Sequence
  Description of Artificial Sequence: Synthetic oligonucleotide
ccgactcggccgagtcgg

SEQ ID NO: 14475 - DNA, 18 bp, Artificial Sequence
  Description of Artificial Sequence: Synthetic oligonucleotide
ttgactcggccgagtcaa

SEQ ID NO: 14476 - DNA, 18 bp, Artificial Sequence
  Description of Artificial Sequence: Synthetic oligonucleotide
tagactcggccgagtcta

SEQ ID NO: 14477 - DNA, 18 bp, Artificial Sequence
  Description of Artificial Sequence: Synthetic oligonucleotide
tggactcggccgagtcca

SEQ ID NO: 14478 - DNA, 18 bp, Artificial Sequence
  Description of Artificial Sequence: Synthetic oligonucleotide
atgactcgcgcgagtcat

SEQ ID NO: 14479 - DNA, 18 bp, Artificial Sequence
  Description of Artificial Sequence: Synthetic oligonucleotide
aagactcgcgcgagtctt

SEQ ID NO: 14480 - DNA, 18 bp, Artificial Sequence
  Description of Artificial Sequence: Synthetic oligonucleotide
aggactcgcgcgagtcct

SEQ ID NO: 14481 - DNA, 18 bp, Artificial Sequence
  Description of Artificial Sequence: Synthetic oligonucleotide
acgactcgcgcgagtcgt

SEQ ID NO: 14482 - DNA, 18 bp, Artificial Sequence
  Description of Artificial Sequence: Synthetic oligonucleotide
gtgactcgcgcgagtcac

SEQ ID NO: 14483 - DNA, 18 bp, Artificial Sequence
  Description of Artificial Sequence: Synthetic oligonucleotide
gagactcgcgcgagtctc

SEQ ID NO: 14484 - DNA, 18 bp, Artificial Sequence
  Description of Artificial Sequence: Synthetic oligonucleotide
gggactcgcgcgagtccc

SEQ ID NO: 14485 - DNA, 18 bp, Artificial Sequence
  Description of Artificial Sequence: Synthetic oligonucleotide
gcgactcgcgcgagtcgc

SEQ ID NO: 14486 - DNA, 18 bp, Artificial Sequence
  Description of Artificial Sequence: Synthetic oligonucleotide
ctgactcgcgcgagtcag

SEQ ID NO: 14487 - DNA, 18 bp, Artificial Sequence
  Description of Artificial Sequence: Synthetic oligonucleotide
cagactcgcgcgagtctg

SEQ ID NO: 14488 - DNA, 18 bp, Artificial Sequence
  Description of Artificial Sequence: Synthetic oligonucleotide
cggactcgcgcgagtccg

SEQ ID NO: 14489 - DNA, 18 bp, Artificial Sequence
  Description of Artificial Sequence: Synthetic oligonucleotide
ccgactcgcgcgagtcgg

SEQ ID NO: 14490 - DNA, 18 bp, Artificial Sequence
  Description of Artificial Sequence: Synthetic oligonucleotide
ttgactcgcgcgagtcaa

SEQ ID NO: 14491 - DNA, 18 bp, Artificial Sequence
  Description of Artificial Sequence: Synthetic oligonucleotide
tagactcgcgcgagtcta

SEQ ID NO: 14492 - DNA, 18 bp, Artificial Sequence
  Description of Artificial Sequence: Synthetic oligonucleotide
tggactcgcgcgagtcca

SEQ ID NO: 14493 - DNA, 18 bp, Artificial Sequence
  Description of Artificial Sequence: Synthetic oligonucleotide
aggactctgcagagtcct

SEQ ID NO: 14494 - DNA, 18 bp, Artificial Sequence
  Description of Artificial Sequence: Synthetic oligonucleotide
acgactctgcagagtcgt

SEQ ID NO: 14495 - DNA, 18 bp, Artificial Sequence
  Description of Artificial Sequence: Synthetic oligonucleotide
gtgactctgcagagtcac

SEQ ID NO: 14496 - DNA, 18 bp, Artificial Sequence
  Description of Artificial Sequence: Synthetic oligonucleotide
gagactctgcagagtctc

SEQ ID NO: 14497 - DNA, 18 bp, Artificial Sequence
  Description of Artificial Sequence: Synthetic oligonucleotide
gggactctgcagagtccc

SEQ ID NO: 14498 - DNA, 18 bp, Artificial Sequence
  Description of Artificial Sequence: Synthetic oligonucleotide
gcgactctgcagagtcgc

SEQ ID NO: 14499 - DNA, 18 bp, Artificial Sequence
  Description of Artificial Sequence: Synthetic oligonucleotide
ctgactctgcagagtcag

SEQ ID NO: 14500 - DNA, 18 bp, Artificial Sequence
  Description of Artificial Sequence: Synthetic oligonucleotide
cagactctgcagagtctg

SEQ ID NO: 14501 - DNA, 18 bp, Artificial Sequence
  Description of Artificial Sequence: Synthetic oligonucleotide
cggactctgcagagtccg

SEQ ID NO: 14502 - DNA, 18 bp, Artificial Sequence
  Description of Artificial Sequence: Synthetic oligonucleotide
ccgactctgcagagtcgg

SEQ ID NO: 14503 - DNA, 18 bp, Artificial Sequence
  Description of Artificial Sequence: Synthetic oligonucleotide
ttgactctgcagagtcaa

SEQ ID NO: 14504 - DNA, 18 bp, Artificial Sequence
  Description of Artificial Sequence: Synthetic oligonucleotide
tggactctgcagagtcca

SEQ ID NO: 14505 - DNA, 18 bp, Artificial Sequence
  Description of Artificial Sequence: Synthetic oligonucleotide
aggactcagctgagtcct

SEQ ID NO: 14506 - DNA, 18 bp, Artificial Sequence
  Description of Artificial Sequence: Synthetic oligonucleotide
acgactcagctgagtcgt

SEQ ID NO: 14507 - DNA, 18 bp, Artificial Sequence
  Description of Artificial Sequence: Synthetic oligonucleotide
gtgactcagctgagtcac

SEQ ID NO: 14508 - DNA, 18 bp, Artificial Sequence
  Description of Artificial Sequence: Synthetic oligonucleotide
gagactcagctgagtctc

SEQ ID NO: 14509 - DNA, 18 bp, Artificial Sequence
  Description of Artificial Sequence: Synthetic oligonucleotide
gggactcagctgagtccc

SEQ ID NO: 14510 - DNA, 18 bp, Artificial Sequence
  Description of Artificial Sequence: Synthetic oligonucleotide
gcgactcagctgagtcgc

SEQ ID NO: 14511 - DNA, 18 bp, Artificial Sequence
  Description of Artificial Sequence: Synthetic oligonucleotide
ctgactcagctgagtcag

SEQ ID NO: 14512 - DNA, 18 bp, Artificial Sequence
  Description of Artificial Sequence: Synthetic oligonucleotide
cagactcagctgagtctg

SEQ ID NO: 14513 - DNA, 18 bp, Artificial Sequence
  Description of Artificial Sequence: Synthetic oligonucleotide
cggactcagctgagtccg

SEQ ID NO: 14514 - DNA, 18 bp, Artificial Sequence
  Description of Artificial Sequence: Synthetic oligonucleotide
ccgactcagctgagtcgg

SEQ ID NO: 14515 - DNA, 18 bp, Artificial Sequence
  Description of Artificial Sequence: Synthetic oligonucleotide
ttgactcagctgagtcaa

SEQ ID NO: 14516 - DNA, 18 bp, Artificial Sequence
  Description of Artificial Sequence: Synthetic oligonucleotide
tggactcagctgagtcca

SEQ ID NO: 14517 - DNA, 18 bp, Artificial Sequence
  Description of Artificial Sequence: Synthetic oligonucleotide
aggactctcgagagtcct

SEQ ID NO: 14518 - DNA, 18 bp, Artificial Sequence
  Description of Artificial Sequence: Synthetic oligonucleotide
acgactctcgagagtcgt

SEQ ID NO: 14519 - DNA, 18 bp, Artificial Sequence
  Description of Artificial Sequence: Synthetic oligonucleotide
gtgactctcgagagtcac

SEQ ID NO: 14520 - DNA, 18 bp, Artificial Sequence
  Description of Artificial Sequence: Synthetic oligonucleotide
gggactctcgagagtccc

SEQ ID NO: 14521 - DNA, 18 bp, Artificial Sequence
  Description of Artificial Sequence: Synthetic oligonucleotide
gcgactctcgagagtcgc

SEQ ID NO: 14522 - DNA, 18 bp, Artificial Sequence
  Description of Artificial Sequence: Synthetic oligonucleotide
ctgactctcgagagtcag

SEQ ID NO: 14523 - DNA, 18 bp, Artificial Sequence
  Description of Artificial Sequence: Synthetic oligonucleotide
cagactctcgagagtctg

SEQ ID NO: 14524 - DNA, 18 bp, Artificial Sequence
  Description of Artificial Sequence: Synthetic oligonucleotide
cggactctcgagagtccg

SEQ ID NO: 14525 - DNA, 18 bp, Artificial Sequence
  Description of Artificial Sequence: Synthetic oligonucleotide
ccgactctcgagagtcgg

SEQ ID NO: 14526 - DNA, 18 bp, Artificial Sequence
  Description of Artificial Sequence: Synthetic oligonucleotide
tggactctcgagagtcca

SEQ ID NO: 14527 - DNA, 18 bp, Artificial Sequence
  Description of Artificial Sequence: Synthetic oligonucleotide
aggactctcgagagtcct

SEQ ID NO: 14528 - DNA, 18 bp, Artificial Sequence
  Description of Artificial Sequence: Synthetic oligonucleotide
acgactctcgagagtcgt

SEQ ID NO: 14529 - DNA, 18 bp, Artificial Sequence
  Description of Artificial Sequence: Synthetic oligonucleotide
gtgactctcgagagtcac

SEQ ID NO: 14530 - DNA, 18 bp, Artificial Sequence
  Description of Artificial Sequence: Synthetic oligonucleotide
gggactctcgagagtccc

SEQ ID NO: 14531 - DNA, 18 bp, Artificial Sequence
  Description of Artificial Sequence: Synthetic oligonucleotide
gcgactctcgagagtcgc

SEQ ID NO: 14532 - DNA, 18 bp, Artificial Sequence
  Description of Artificial Sequence: Synthetic oligonucleotide
ctgactctcgagagtcag

SEQ ID NO: 14533 - DNA, 18 bp, Artificial Sequence
  Description of Artificial Sequence: Synthetic oligonucleotide
cagactctcgagagtctg

SEQ ID NO: 14534 - DNA, 18 bp, Artificial Sequence
  Description of Artificial Sequence: Synthetic oligonucleotide
cggactctcgagagtccg

SEQ ID NO: 14535 - DNA, 18 bp, Artificial Sequence
  Description of Artificial Sequence: Synthetic oligonucleotide
ccgactctcgagagtcgg

SEQ ID NO: 14536 - DNA, 18 bp, Artificial Sequence
  Description of Artificial Sequence: Synthetic oligonucleotide
tggactctcgagagtcca

SEQ ID NO: 14537 - DNA, 18 bp, Artificial Sequence
  Description of Artificial Sequence: Synthetic oligonucleotide
atgactcacgtgagtcat

SEQ ID NO: 14538 - DNA, 18 bp, Artificial Sequence
  Description of Artificial Sequence: Synthetic oligonucleotide
aggactcacgtgagtcct

SEQ ID NO: 14539 - DNA, 18 bp, Artificial Sequence
  Description of Artificial Sequence: Synthetic oligonucleotide
acgactcacgtgagtcgt

SEQ ID NO: 14540 - DNA, 18 bp, Artificial Sequence
  Description of Artificial Sequence: Synthetic oligonucleotide
gtgactcacgtgagtcac

SEQ ID NO: 14541 - DNA, 18 bp, Artificial Sequence
  Description of Artificial Sequence: Synthetic oligonucleotide
gagactcacgtgagtctc

SEQ ID NO: 14542 - DNA, 18 bp, Artificial Sequence
  Description of Artificial Sequence: Synthetic oligonucleotide
gggactcacgtgagtccc

SEQ ID NO: 14543 - DNA, 18 bp, Artificial Sequence
  Description of Artificial Sequence: Synthetic oligonucleotide
gcgactcacgtgagtcgc

SEQ ID NO: 14544 - DNA, 18 bp, Artificial Sequence
  Description of Artificial Sequence: Synthetic oligonucleotide
ctgactcacgtgagtcag

SEQ ID NO: 14545 - DNA, 18 bp, Artificial Sequence
  Description of Artificial Sequence: Synthetic oligonucleotide
cagactcacgtgagtctg

SEQ ID NO: 14546 - DNA, 18 bp, Artificial Sequence
  Description of Artificial Sequence: Synthetic oligonucleotide
cggactcacgtgagtccg

SEQ ID NO: 14547 - DNA, 18 bp, Artificial Sequence
  Description of Artificial Sequence: Synthetic oligonucleotide
ccgactcacgtgagtcgg

SEQ ID NO: 14548 - DNA, 18 bp, Artificial Sequence
  Description of Artificial Sequence: Synthetic oligonucleotide
ttgactcacgtgagtcaa

SEQ ID NO: 14549 - DNA, 18 bp, Artificial Sequence
  Description of Artificial Sequence: Synthetic oligonucleotide
tggactcacgtgagtcca

SEQ ID NO: 14550 - DNA, 18 bp, Artificial Sequence
  Description of Artificial Sequence: Synthetic oligonucleotide
aggactccatggagtcct

SEQ ID NO: 14551 - DNA, 18 bp, Artificial Sequence
  Description of Artificial Sequence: Synthetic oligonucleotide
acgactccatggagtcgt

SEQ ID NO: 14552 - DNA, 18 bp, Artificial Sequence
  Description of Artificial Sequence: Synthetic oligonucleotide
gtgactccatggagtcac

SEQ ID NO: 14553 - DNA, 18 bp, Artificial Sequence
  Description of Artificial Sequence: Synthetic oligonucleotide
gagactccatggagtctc

SEQ ID NO: 14554 - DNA, 18 bp, Artificial Sequence
  Description of Artificial Sequence: Synthetic oligonucleotide
gggactccatggagtccc

SEQ ID NO: 14555 - DNA, 18 bp, Artificial Sequence
  Description of Artificial Sequence: Synthetic oligonucleotide
gcgactccatggagtcgc

SEQ ID NO: 14556 - DNA, 18 bp, Artificial Sequence
  Description of Artificial Sequence: Synthetic oligonucleotide
ctgactccatggagtcag

SEQ ID NO: 14557 - DNA, 18 bp, Artificial Sequence
  Description of Artificial Sequence: Synthetic oligonucleotide
cagactccatggagtctg

SEQ ID NO: 14558 - DNA, 18 bp, Artificial Sequence
  Description of Artificial Sequence: Synthetic oligonucleotide
cggactccatggagtccg

SEQ ID NO: 14559 - DNA, 18 bp, Artificial Sequence
  Description of Artificial Sequence: Synthetic oligonucleotide
ccgactccatggagtcgg

SEQ ID NO: 14560 - DNA, 18 bp, Artificial Sequence
  Description of Artificial Sequence: Synthetic oligonucleotide
ttgactccatggagtcaa

SEQ ID NO: 14561 - DNA, 18 bp, Artificial Sequence
  Description of Artificial Sequence: Synthetic oligonucleotide
tggactccatggagtcca

SEQ ID NO: 14562 - DNA, 18 bp, Artificial Sequence
  Description of Artificial Sequence: Synthetic oligonucleotide
aggactcgtacgagtcct

SEQ ID NO: 14563 - DNA, 18 bp, Artificial Sequence
  Description of Artificial Sequence: Synthetic oligonucleotide
acgactcgtacgagtcgt

SEQ ID NO: 14564 - DNA, 18 bp, Artificial Sequence
  Description of Artificial Sequence: Synthetic oligonucleotide
gtgactcgtacgagtcac

SEQ ID NO: 14565 - DNA, 18 bp, Artificial Sequence
  Description of Artificial Sequence: Synthetic oligonucleotide
gagactcgtacgagtctc

SEQ ID NO: 14566 - DNA, 18 bp, Artificial Sequence
  Description of Artificial Sequence: Synthetic oligonucleotide
gggactcgtacgagtccc

SEQ ID NO: 14567 - DNA, 18 bp, Artificial Sequence
  Description of Artificial Sequence: Synthetic oligonucleotide
gcgactcgtacgagtcgc

SEQ ID NO: 14568 - DNA, 18 bp, Artificial Sequence
  Description of Artificial Sequence: Synthetic oligonucleotide
ctgactcgtacgagtcag

SEQ ID NO: 14569 - DNA, 18 bp, Artificial Sequence
  Description of Artificial Sequence: Synthetic oligonucleotide
cagactcgtacgagtctg

SEQ ID NO: 14570 - DNA, 18 bp, Artificial Sequence
  Description of Artificial Sequence: Synthetic oligonucleotide
cggactcgtacgagtccg

SEQ ID NO: 14571 - DNA, 18 bp, Artificial Sequence
  Description of Artificial Sequence: Synthetic oligonucleotide
ccgactcgtacgagtcgg

SEQ ID NO: 14572 - DNA, 18 bp, Artificial Sequence
  Description of Artificial Sequence: Synthetic oligonucleotide
tggactcgtacgagtcca

SEQ ID NO: 14573 - DNA, 18 bp, Artificial Sequence
  Description of Artificial Sequence: Synthetic oligonucleotide
aggactcctaggagtcct

SEQ ID NO: 14574 - DNA, 18 bp, Artificial Sequence
  Description of Artificial Sequence: Synthetic oligonucleotide
acgactcctaggagtcgt

SEQ ID NO: 14575 - DNA, 18 bp, Artificial Sequence
  Description of Artificial Sequence: Synthetic oligonucleotide
gtgactcctaggagtcac

SEQ ID NO: 14576 - DNA, 18 bp, Artificial Sequence
  Description of Artificial Sequence: Synthetic oligonucleotide
gggactcctaggagtccc

SEQ ID NO: 14577 - DNA, 18 bp, Artificial Sequence
  Description of Artificial Sequence: Synthetic oligonucleotide
gcgactcctaggagtcgc

SEQ ID NO: 14578 - DNA, 18 bp, Artificial Sequence
  Description of Artificial Sequence: Synthetic oligonucleotide
cggactcctaggagtccg

SEQ ID NO: 14579 - DNA, 18 bp, Artificial Sequence
  Description of Artificial Sequence: Synthetic oligonucleotide
ccgactcctaggagtcgg

SEQ ID NO: 14580 - DNA, 18 bp, Artificial Sequence
  Description of Artificial Sequence: Synthetic oligonucleotide
tggactcctaggagtcca

SEQ ID NO: 14581 - DNA, 16 bp, Artificial Sequence
  Description of Artificial Sequence: Synthetic oligonucleotide
tgactccgcggagtca

SEQ ID NO: 14582 - DNA, 16 bp, Artificial Sequence
  Description of Artificial Sequence: Synthetic oligonucleotide
agactccgcggagtct

SEQ ID NO: 14583 - DNA, 16 bp, Artificial Sequence
  Description of Artificial Sequence: Synthetic oligonucleotide
ggactccgcggagtcc

SEQ ID NO: 14584 - DNA, 16 bp, Artificial Sequence
  Description of Artificial Sequence: Synthetic oligonucleotide
cgactccgcggagtcg

SEQ ID NO: 14585 - DNA, 16 bp, Artificial Sequence
  Description of Artificial Sequence: Synthetic oligonucleotide
tgactcggccgagtca

SEQ ID NO: 14586 - DNA, 16 bp, Artificial Sequence
  Description of Artificial Sequence: Synthetic oligonucleotide
agactcggccgagtct

SEQ ID NO: 14587 - DNA, 16 bp, Artificial Sequence
  Description of Artificial Sequence: Synthetic oligonucleotide
ggactcggccgagtcc

SEQ ID NO: 14588 - DNA, 16 bp, Artificial Sequence
  Description of Artificial Sequence: Synthetic oligonucleotide
cgactcggccgagtcg

SEQ ID NO: 14589 - DNA, 16 bp, Artificial Sequence
  Description of Artificial Sequence: Synthetic oligonucleotide
tgactcgcgcgagtca

SEQ ID NO: 14590 - DNA, 16 bp, Artificial Sequence
  Description of Artificial Sequence: Synthetic oligonucleotide
agactcgcgcgagtct

SEQ ID NO: 14591 - DNA, 16 bp, Artificial Sequence
  Description of Artificial Sequence: Synthetic oligonucleotide
ggactcgcgcgagtcc

SEQ ID NO: 14592 - DNA, 16 bp, Artificial Sequence
  Description of Artificial Sequence: Synthetic oligonucleotide
cgactcgcgcgagtcg

SEQ ID NO: 14593 - DNA, 16 bp, Artificial Sequence
  Description of Artificial Sequence: Synthetic oligonucleotide
tgactcccgggagtca

SEQ ID NO: 14594 - DNA, 16 bp, Artificial Sequence
  Description of Artificial Sequence: Synthetic oligonucleotide
agactcccgggagtct

SEQ ID NO: 14595 - DNA, 16 bp, Artificial Sequence
  Description of Artificial Sequence: Synthetic oligonucleotide
ggactcccgggagtcc

SEQ ID NO: 14596 - DNA, 16 bp, Artificial Sequence
  Description of Artificial Sequence: Synthetic oligonucleotide
cgactcccgggagtcg

SEQ ID NO: 14597 - DNA, 16 bp, Artificial Sequence
  Description of Artificial Sequence: Synthetic oligonucleotide
ggactctgcagagtcc

SEQ ID NO: 14598 - DNA, 16 bp, Artificial Sequence
  Description of Artificial Sequence: Synthetic oligonucleotide
cgactctgcagagtcg

SEQ ID NO: 14599 - DNA, 16 bp, Artificial Sequence
  Description of Artificial Sequence: Synthetic oligonucleotide
ggactcagctgagtcc

SEQ ID NO: 14600 - DNA, 16 bp, Artificial Sequence
  Description of Artificial Sequence: Synthetic oligonucleotide
cgactcagctgagtcg

SEQ ID NO: 14601 - DNA, 16 bp, Artificial Sequence
  Description of Artificial Sequence: Synthetic oligonucleotide
ggactctcgagagtcc

SEQ ID NO: 14602 - DNA, 16 bp, Artificial Sequence
  Description of Artificial Sequence: Synthetic oligonucleotide
cgactctcgagagtcg

SEQ ID NO: 14603 - DNA, 16 bp, Artificial Sequence
  Description of Artificial Sequence: Synthetic oligonucleotide
ggactcacgtgagtcc

SEQ ID NO: 14604 - DNA, 16 bp, Artificial Sequence
  Description of Artificial Sequence: Synthetic oligonucleotide
cgactcacgtgagtcg

SEQ ID NO: 14605 - DNA, 16 bp, Artificial Sequence
  Description of Artificial Sequence: Synthetic oligonucleotide
ggactccatggagtcc

SEQ ID NO: 14606 - DNA, 16 bp, Artificial Sequence
  Description of Artificial Sequence: Synthetic oligonucleotide
cgactccatggagtcg

SEQ ID NO: 14607 - DNA, 16 bp, Artificial Sequence
  Description of Artificial Sequence: Synthetic oligonucleotide
ggactcgtacgagtcc

SEQ ID NO: 14608 - DNA, 16 bp, Artificial Sequence
  Description of Artificial Sequence: Synthetic oligonucleotide
cgactcgtacgagtcg

SEQ ID NO: 14609 - DNA, 16 bp, Artificial Sequence
  Description of Artificial Sequence: Synthetic oligonucleotide
ggactcctaggagtcc

SEQ ID NO: 14610 - DNA, 16 bp, Artificial Sequence
  Description of Artificial Sequence: Synthetic oligonucleotide
cgactcctaggagtcg

SEQ ID NO: 14611 - DNA, 19 bp, Artificial Sequence
  Description of Artificial Sequence: Synthetic oligonucleotide
tcagactcgcgagtctgaa

SEQ ID NO: 14612 - DNA, 19 bp, Artificial Sequence
  Description of Artificial Sequence: Synthetic oligonucleotide
tcagactcgcgagtctgat

SEQ ID NO: 14613 - DNA, 19 bp, Artificial Sequence
  Description of Artificial Sequence: Synthetic oligonucleotide
tcagactcgcgagtctgac

SEQ ID NO: 14614 - DNA, 19 bp, Artificial Sequence
  Description of Artificial Sequence: Synthetic oligonucleotide
tcagactcgcgagtctgag

SEQ ID NO: 14615 - DNA, 19 bp, Artificial Sequence
  Description of Artificial Sequence: Synthetic oligonucleotide
acagactcgcgagtctgta

SEQ ID NO: 14616 - DNA, 19 bp, Artificial Sequence
  Description of Artificial Sequence: Synthetic oligonucleotide
acagactcgcgagtctgtt

SEQ ID NO: 14617 - DNA, 19 bp, Artificial Sequence
  Description of Artificial Sequence: Synthetic oligonucleotide
acagactcgcgagtctgtc

SEQ ID NO: 14618 - DNA, 19 bp, Artificial Sequence
  Description of Artificial Sequence: Synthetic oligonucleotide
acagactcgcgagtctgtg

SEQ ID NO: 14619 - DNA, 19 bp, Artificial Sequence
  Description of Artificial Sequence: Synthetic oligonucleotide
gcagactcgcgagtctgct

SEQ ID NO: 14620 - DNA, 19 bp, Artificial Sequence
  Description of Artificial Sequence: Synthetic oligonucleotide
gcagactcgcgagtctgcc

SEQ ID NO: 14621 - DNA, 19 bp, Artificial Sequence
  Description of Artificial Sequence: Synthetic oligonucleotide
gcagactcgcgagtctgcg

SEQ ID NO: 14622 - DNA, 19 bp, Artificial Sequence
  Description of Artificial Sequence: Synthetic oligonucleotide
ccagactcgcgagtctgga

SEQ ID NO: 14623 - DNA, 19 bp, Artificial Sequence
  Description of Artificial Sequence: Synthetic oligonucleotide
ccagactcgcgagtctggt

SEQ ID NO: 14624 - DNA, 19 bp, Artificial Sequence
  Description of Artificial Sequence: Synthetic oligonucleotide
ccagactcgcgagtctggc

SEQ ID NO: 14625 - DNA, 19 bp, Artificial Sequence
  Description of Artificial Sequence: Synthetic oligonucleotide
ccagactcgcgagtctggg

SEQ ID NO: 14626 - DNA, 19 bp, Artificial Sequence
  Description of Artificial Sequence: Synthetic oligonucleotide
tctgactcgcgagtcagaa

SEQ ID NO: 14627 - DNA, 19 bp, Artificial Sequence
  Description of Artificial Sequence: Synthetic oligonucleotide
tctgactcgcgagtcagat

SEQ ID NO: 14628 - DNA, 19 bp, Artificial Sequence
  Description of Artificial Sequence: Synthetic oligonucleotide
tctgactcgcgagtcagac

SEQ ID NO: 14629 - DNA, 19 bp, Artificial Sequence
  Description of Artificial Sequence: Synthetic oligonucleotide
tctgactcgcgagtcagag

SEQ ID NO: 14630 - DNA, 19 bp, Artificial Sequence
  Description of Artificial Sequence: Synthetic oligonucleotide
actgactcgcgagtcagta

SEQ ID NO: 14631 - DNA, 19 bp, Artificial Sequence
  Description of Artificial Sequence: Synthetic oligonucleotide
actgactcgcgagtcagtt

SEQ ID NO: 14632 - DNA, 19 bp, Artificial Sequence
  Description of Artificial Sequence: Synthetic oligonucleotide
actgactcgcgagtcagtc

SEQ ID NO: 14633 - DNA, 19 bp, Artificial Sequence
  Description of Artificial Sequence: Synthetic oligonucleotide
actgactcgcgagtcagtg

SEQ ID NO: 14634 - DNA, 19 bp, Artificial Sequence
  Description of Artificial Sequence: Synthetic oligonucleotide
gctgactcgcgagtcagca

SEQ ID NO: 14635 - DNA, 19 bp, Artificial Sequence
  Description of Artificial Sequence: Synthetic oligonucleotide
gctgactcgcgagtcagcc

SEQ ID NO: 14636 - DNA, 19 bp, Artificial Sequence
  Description of Artificial Sequence: Synthetic oligonucleotide
gctgactcgcgagtcagcg

SEQ ID NO: 14637 - DNA, 19 bp, Artificial Sequence
  Description of Artificial Sequence: Synthetic oligonucleotide
cctgactcgcgagtcagga

SEQ ID NO: 14638 - DNA, 19 bp, Artificial Sequence
  Description of Artificial Sequence: Synthetic oligonucleotide
cctgactcgcgagtcaggt

SEQ ID NO: 14639 - DNA, 19 bp, Artificial Sequence
  Description of Artificial Sequence: Synthetic oligonucleotide
cctgactcgcgagtcaggc

SEQ ID NO: 14640 - DNA, 19 bp, Artificial Sequence
  Description of Artificial Sequence: Synthetic oligonucleotide
cctgactcgcgagtcaggg

SEQ ID NO: 14641 - DNA, 19 bp, Artificial Sequence
  Description of Artificial Sequence: Synthetic oligonucleotide
tacgactcgcgagtcgtaa

SEQ ID NO: 14642 - DNA, 19 bp, Artificial Sequence
  Description of Artificial Sequence: Synthetic oligonucleotide
tacgactcgcgagtcgtat

SEQ ID NO: 14643 - DNA, 19 bp, Artificial Sequence
  Description of Artificial Sequence: Synthetic oligonucleotide
tacgactcgcgagtcgtag

SEQ ID NO: 14644 - DNA, 19 bp, Artificial Sequence
  Description of Artificial Sequence: Synthetic oligonucleotide
aacgactcgcgagtcgtta

SEQ ID NO: 14645 - DNA, 19 bp, Artificial Sequence
  Description of Artificial Sequence: Synthetic oligonucleotide
aacgactcgcgagtcgttt

SEQ ID NO: 14646 - DNA, 19 bp, Artificial Sequence
  Description of Artificial Sequence: Synthetic oligonucleotide
aacgactcgcgagtcgttc

SEQ ID NO: 14647 - DNA, 19 bp, Artificial Sequence
  Description of Artificial Sequence: Synthetic oligonucleotide
aacgactcgcgagtcgttg

SEQ ID NO: 14648 - DNA, 19 bp, Artificial Sequence
  Description of Artificial Sequence: Synthetic oligonucleotide
gacgactcgcgagtcgtca

SEQ ID NO: 14649 - DNA, 19 bp, Artificial Sequence
  Description of Artificial Sequence: Synthetic oligonucleotide
gacgactcgcgagtcgtct

SEQ ID NO: 14650 - DNA, 19 bp, Artificial Sequence
  Description of Artificial Sequence: Synthetic oligonucleotide
gacgactcgcgagtcgtcc

SEQ ID NO: 14651 - DNA, 19 bp, Artificial Sequence
  Description of Artificial Sequence: Synthetic oligonucleotide
gacgactcgcgagtcgtcg

SEQ ID NO: 14652 - DNA, 19 bp, Artificial Sequence
  Description of Artificial Sequence: Synthetic oligonucleotide
cacgactcgcgagtcgtga

SEQ ID NO: 14653 - DNA, 19 bp, Artificial Sequence
  Description of Artificial Sequence: Synthetic oligonucleotide
cacgactcgcgagtcgtgt

SEQ ID NO: 14654 - DNA, 19 bp, Artificial Sequence
  Description of Artificial Sequence: Synthetic oligonucleotide
cacgactcgcgagtcgtgc

SEQ ID NO: 14655 - DNA, 19 bp, Artificial Sequence
  Description of Artificial Sequence: Synthetic oligonucleotide
cacgactcgcgagtcgtgg

SEQ ID NO: 14656 - DNA, 19 bp, Artificial Sequence
  Description of Artificial Sequence: Synthetic oligonucleotide
tccgactcgcgagtcggaa

SEQ ID NO: 14657 - DNA, 19 bp, Artificial Sequence
  Description of Artificial Sequence: Synthetic oligonucleotide
tccgactcgcgagtcggat

SEQ ID NO: 14658 - DNA, 19 bp, Artificial Sequence
  Description of Artificial Sequence: Synthetic oligonucleotide
tccgactcgcgagtcggac

SEQ ID NO: 14659 - DNA, 19 bp, Artificial Sequence
  Description of Artificial Sequence: Synthetic oligonucleotide
tccgactcgcgagtcggag

SEQ ID NO: 14660 - DNA, 19 bp, Artificial Sequence
  Description of Artificial Sequence: Synthetic oligonucleotide
accgactcgcgagtcggta

SEQ ID NO: 14661 - DNA, 19 bp, Artificial Sequence
  Description of Artificial Sequence: Synthetic oligonucleotide
accgactcgcgagtcggtt

SEQ ID NO: 14662 - DNA, 19 bp, Artificial Sequence
  Description of Artificial Sequence: Synthetic oligonucleotide
accgactcgcgagtcggtc

SEQ ID NO: 14663 - DNA, 19 bp, Artificial Sequence
  Description of Artificial Sequence: Synthetic oligonucleotide
accgactcgcgagtcggtg

SEQ ID NO: 14664 - DNA, 19 bp, Artificial Sequence
  Description of Artificial Sequence: Synthetic oligonucleotide
gccgactcgcgagtcggca

SEQ ID NO: 14665 - DNA, 19 bp, Artificial Sequence
  Description of Artificial Sequence: Synthetic oligonucleotide
gccgactcgcgagtcggct

SEQ ID NO: 14666 - DNA, 19 bp, Artificial Sequence
  Description of Artificial Sequence: Synthetic oligonucleotide
gccgactcgcgagtcggcg

SEQ ID NO: 14667 - DNA, 19 bp, Artificial Sequence
  Description of Artificial Sequence: Synthetic oligonucleotide
cccgactcgcgagtcggga

SEQ ID NO: 14668 - DNA, 19 bp, Artificial Sequence
  Description of Artificial Sequence: Synthetic oligonucleotide
cccgactcgcgagtcgggt

SEQ ID NO: 14669 - DNA, 19 bp, Artificial Sequence
  Description of Artificial Sequence: Synthetic oligonucleotide
cccgactcgcgagtcgggc

SEQ ID NO: 14670 - DNA, 19 bp, Artificial Sequence
  Description of Artificial Sequence: Synthetic oligonucleotide
tgagactcgcgagtctcaa

SEQ ID NO: 14671 - DNA, 19 bp, Artificial Sequence
  Description of Artificial Sequence: Synthetic oligonucleotide
tgagactcgcgagtctcat

SEQ ID NO: 14672 - DNA, 19 bp, Artificial Sequence
  Description of Artificial Sequence: Synthetic oligonucleotide
tgagactcgcgagtctcac

SEQ ID NO: 14673 - DNA, 19 bp, Artificial Sequence
  Description of Artificial Sequence: Synthetic oligonucleotide
tgagactcgcgagtctcag

SEQ ID NO: 14674 - DNA, 19 bp, Artificial Sequence
  Description of Artificial Sequence: Synthetic oligonucleotide
agagactcgcgagtctcta

SEQ ID NO: 14675 - DNA, 19 bp, Artificial Sequence
  Description of Artificial Sequence: Synthetic oligonucleotide
agagactcgcgagtctctt

SEQ ID NO: 14676 - DNA, 19 bp, Artificial Sequence
  Description of Artificial Sequence: Synthetic oligonucleotide
agagactcgcgagtctctc

SEQ ID NO: 14677 - DNA, 19 bp, Artificial Sequence
  Description of Artificial Sequence: Synthetic oligonucleotide
agagactcgcgagtctctg

SEQ ID NO: 14678 - DNA, 19 bp, Artificial Sequence
  Description of Artificial Sequence: Synthetic oligonucleotide
ggagactcgcgagtctcca

SEQ ID NO: 14679 - DNA, 19 bp, Artificial Sequence
  Description of Artificial Sequence: Synthetic oligonucleotide
ggagactcgcgagtctcct

SEQ ID NO: 14680 - DNA, 19 bp, Artificial Sequence
  Description of Artificial Sequence: Synthetic oligonucleotide
ggagactcgcgagtctccc

SEQ ID NO: 14681 - DNA, 19 bp, Artificial Sequence
  Description of Artificial Sequence: Synthetic oligonucleotide
ggagactcgcgagtctccg

SEQ ID NO: 14682 - DNA, 19 bp, Artificial Sequence
  Description of Artificial Sequence: Synthetic oligonucleotide
cgagactcgcgagtctcgt

SEQ ID NO: 14683 - DNA, 19 bp, Artificial Sequence
  Description of Artificial Sequence: Synthetic oligonucleotide
cgagactcgcgagtctcgc

SEQ ID NO: 14684 - DNA, 19 bp, Artificial Sequence
  Description of Artificial Sequence: Synthetic oligonucleotide
cgagactcgcgagtctcgg

SEQ ID NO: 14685 - DNA, 19 bp, Artificial Sequence
  Description of Artificial Sequence: Synthetic oligonucleotide
tgtgactcgcgagtcacaa

SEQ ID NO: 14686 - DNA, 19 bp, Artificial Sequence
  Description of Artificial Sequence: Synthetic oligonucleotide
tgtgactcgcgagtcacat

SEQ ID NO: 14687 - DNA, 19 bp, Artificial Sequence
  Description of Artificial Sequence: Synthetic oligonucleotide
tgtgactcgcgagtcacac

SEQ ID NO: 14688 - DNA, 19 bp, Artificial Sequence
  Description of Artificial Sequence: Synthetic oligonucleotide
tgtgactcgcgagtcacag

SEQ ID NO: 14689 - DNA, 19 bp, Artificial Sequence
  Description of Artificial Sequence: Synthetic oligonucleotide
agtgactcgcgagtcacta

SEQ ID NO: 14690 - DNA, 19 bp, Artificial Sequence
  Description of Artificial Sequence: Synthetic oligonucleotide
agtgactcgcgagtcactt

SEQ ID NO: 14691 - DNA, 19 bp, Artificial Sequence
  Description of Artificial Sequence: Synthetic oligonucleotide
agtgactcgcgagtcactc

SEQ ID NO: 14692 - DNA, 19 bp, Artificial Sequence
  Description of Artificial Sequence: Synthetic oligonucleotide
agtgactcgcgagtcactg

SEQ ID NO: 14693 - DNA, 19 bp, Artificial Sequence
  Description of Artificial Sequence: Synthetic oligonucleotide
ggtgactcgcgagtcacca

SEQ ID NO: 14694 - DNA, 19 bp, Artificial Sequence
  Description of Artificial Sequence: Synthetic oligonucleotide
ggtgactcgcgagtcacct

SEQ ID NO: 14695 - DNA, 19 bp, Artificial Sequence
  Description of Artificial Sequence: Synthetic oligonucleotide
ggtgactcgcgagtcaccc

SEQ ID NO: 14696 - DNA, 19 bp, Artificial Sequence
  Description of Artificial Sequence: Synthetic oligonucleotide
ggtgactcgcgagtcaccg

SEQ ID NO: 14697 - DNA, 19 bp, Artificial Sequence
  Description of Artificial Sequence: Synthetic oligonucleotide
cgtgactcgcgagtcacga

SEQ ID NO: 14698 - DNA, 19 bp, Artificial Sequence
  Description of Artificial Sequence: Synthetic oligonucleotide
cgtgactcgcgagtcacgc

SEQ ID NO: 14699 - DNA, 19 bp, Artificial Sequence
  Description of Artificial Sequence: Synthetic oligonucleotide
cgtgactcgcgagtcacgg

SEQ ID NO: 14700 - DNA, 19 bp, Artificial Sequence
  Description of Artificial Sequence: Synthetic oligonucleotide
taggactcgcgagtcctaa

SEQ ID NO: 14701 - DNA, 19 bp, Artificial Sequence
  Description of Artificial Sequence: Synthetic oligonucleotide
taggactcgcgagtcctat

SEQ ID NO: 14702 - DNA, 19 bp, Artificial Sequence
  Description of Artificial Sequence: Synthetic oligonucleotide
taggactcgcgagtcctac

SEQ ID NO: 14703 - DNA, 19 bp, Artificial Sequence
  Description of Artificial Sequence: Synthetic oligonucleotide
aaggactcgcgagtcctta

SEQ ID NO: 14704 - DNA, 19 bp, Artificial Sequence
  Description of Artificial Sequence: Synthetic oligonucleotide
aaggactcgcgagtccttt

SEQ ID NO: 14705 - DNA, 19 bp, Artificial Sequence
  Description of Artificial Sequence: Synthetic oligonucleotide
aaggactcgcgagtccttc

SEQ ID NO: 14706 - DNA, 19 bp, Artificial Sequence
  Description of Artificial Sequence: Synthetic oligonucleotide
aaggactcgcgagtccttg

SEQ ID NO: 14707 - DNA, 19 bp, Artificial Sequence
  Description of Artificial Sequence: Synthetic oligonucleotide
gaggactcgcgagtcctca

SEQ ID NO: 14708 - DNA, 19 bp, Artificial Sequence
  Description of Artificial Sequence: Synthetic oligonucleotide
gaggactcgcgagtcctct

SEQ ID NO: 14709 - DNA, 19 bp, Artificial Sequence
  Description of Artificial Sequence: Synthetic oligonucleotide
gaggactcgcgagtcctcc

SEQ ID NO: 14710 - DNA, 19 bp, Artificial Sequence
  Description of Artificial Sequence: Synthetic oligonucleotide
gaggactcgcgagtcctcg

SEQ ID NO: 14711 - DNA, 19 bp, Artificial Sequence
  Description of Artificial Sequence: Synthetic oligonucleotide
caggactcgcgagtcctga

SEQ ID NO: 14712 - DNA, 19 bp, Artificial Sequence
  Description of Artificial Sequence: Synthetic oligonucleotide
caggactcgcgagtcctgt

SEQ ID NO: 14713 - DNA, 19 bp, Artificial Sequence
  Description of Artificial Sequence: Synthetic oligonucleotide
caggactcgcgagtcctgc

SEQ ID NO: 14714 - DNA, 19 bp, Artificial Sequence
  Description of Artificial Sequence: Synthetic oligonucleotide
caggactcgcgagtcctgg

SEQ ID NO: 14715 - DNA, 19 bp, Artificial Sequence
  Description of Artificial Sequence: Synthetic oligonucleotide
ttggactcgcgagtccaaa

SEQ ID NO: 14716 - DNA, 19 bp, Artificial Sequence
  Description of Artificial Sequence: Synthetic oligonucleotide
ttggactcgcgagtccaat

SEQ ID NO: 14717 - DNA, 19 bp, Artificial Sequence
  Description of Artificial Sequence: Synthetic oligonucleotide
ttggactcgcgagtccaac

SEQ ID NO: 14718 - DNA, 19 bp, Artificial Sequence
  Description of Artificial Sequence: Synthetic oligonucleotide
ttggactcgcgagtccaag

SEQ ID NO: 14719 - DNA, 19 bp, Artificial Sequence
  Description of Artificial Sequence: Synthetic oligonucleotide
atggactcgcgagtccata

SEQ ID NO: 14720 - DNA, 19 bp, Artificial Sequence
  Description of Artificial Sequence: Synthetic oligonucleotide
atggactcgcgagtccatt

SEQ ID NO: 14721 - DNA, 19 bp, Artificial Sequence
  Description of Artificial Sequence: Synthetic oligonucleotide
atggactcgcgagtccatc

SEQ ID NO: 14722 - DNA, 19 bp, Artificial Sequence
  Description of Artificial Sequence: Synthetic oligonucleotide
gtggactcgcgagtccaca

SEQ ID NO: 14723 - DNA, 19 bp, Artificial Sequence
  Description of Artificial Sequence: Synthetic oligonucleotide
gtggactcgcgagtccact

SEQ ID NO: 14724 - DNA, 19 bp, Artificial Sequence
  Description of Artificial Sequence: Synthetic oligonucleotide
gtggactcgcgagtccacc

SEQ ID NO: 14725 - DNA, 19 bp, Artificial Sequence
  Description of Artificial Sequence: Synthetic oligonucleotide
gtggactcgcgagtccacg

SEQ ID NO: 14726 - DNA, 19 bp, Artificial Sequence
  Description of Artificial Sequence: Synthetic oligonucleotide
ctggactcgcgagtccaga

SEQ ID NO: 14727 - DNA, 19 bp, Artificial Sequence
  Description of Artificial Sequence: Synthetic oligonucleotide
ctggactcgcgagtccagt

SEQ ID NO: 14728 - DNA, 19 bp, Artificial Sequence
  Description of Artificial Sequence: Synthetic oligonucleotide
ctggactcgcgagtccagc

SEQ ID NO: 14729 - DNA, 19 bp, Artificial Sequence
  Description of Artificial Sequence: Synthetic oligonucleotide
ctggactcgcgagtccagg

SEQ ID NO: 14730 - DNA, 19 bp, Artificial Sequence
  Description of Artificial Sequence: Synthetic oligonucleotide
tgggactcgcgagtcccaa

SEQ ID NO: 14731 - DNA, 19 bp, Artificial Sequence
  Description of Artificial Sequence: Synthetic oligonucleotide
tgggactcgcgagtcccat

SEQ ID NO: 14732 - DNA, 19 bp, Artificial Sequence
  Description of Artificial Sequence: Synthetic oligonucleotide
tgggactcgcgagtcccac

SEQ ID NO: 14733 - DNA, 19 bp, Artificial Sequence
  Description of Artificial Sequence: Synthetic oligonucleotide
tgggactcgcgagtcccag

SEQ ID NO: 14734 - DNA, 19 bp, Artificial Sequence
  Description of Artificial Sequence: Synthetic oligonucleotide
agggactcgcgagtcccta

SEQ ID NO: 14735 - DNA, 19 bp, Artificial Sequence
  Description of Artificial Sequence: Synthetic oligonucleotide
agggactcgcgagtccctt

SEQ ID NO: 14736 - DNA, 19 bp, Artificial Sequence
  Description of Artificial Sequence: Synthetic oligonucleotide
agggactcgcgagtccctc

SEQ ID NO: 14737 - DNA, 19 bp, Artificial Sequence
  Description of Artificial Sequence: Synthetic oligonucleotide
agggactcgcgagtccctg

SEQ ID NO: 14738 - DNA, 19 bp, Artificial Sequence
  Description of Artificial Sequence: Synthetic oligonucleotide
ggggactcgcgagtcccca

SEQ ID NO: 14739 - DNA, 19 bp, Artificial Sequence
  Description of Artificial Sequence: Synthetic oligonucleotide
ggggactcgcgagtcccct

SEQ ID NO: 14740 - DNA, 19 bp, Artificial Sequence
  Description of Artificial Sequence: Synthetic oligonucleotide
ggggactcgcgagtccccg

SEQ ID NO: 14741 - DNA, 19 bp, Artificial Sequence
  Description of Artificial Sequence: Synthetic oligonucleotide
cgggactcgcgagtcccga

SEQ ID NO: 14742 - DNA, 19 bp, Artificial Sequence
  Description of Artificial Sequence: Synthetic oligonucleotide
cgggactcgcgagtcccgt

SEQ ID NO: 14743 - DNA, 19 bp, Artificial Sequence
  Description of Artificial Sequence: Synthetic oligonucleotide
cgggactcgcgagtcccgc

SEQ ID NO: 14744 - DNA, 19 bp, Artificial Sequence
  Description of Artificial Sequence: Synthetic oligonucleotide
aaagactcgcgagtcttta

SEQ ID NO: 14745 - DNA, 19 bp, Artificial Sequence
  Description of Artificial Sequence: Synthetic oligonucleotide
aaagactcgcgagtctttt

SEQ ID NO: 14746 - DNA, 19 bp, Artificial Sequence
  Description of Artificial Sequence: Synthetic oligonucleotide
aaagactcgcgagtctttc

SEQ ID NO: 14747 - DNA, 19 bp, Artificial Sequence
  Description of Artificial Sequence: Synthetic oligonucleotide
aaagactcgcgagtctttg

SEQ ID NO: 14748 - DNA, 19 bp, Artificial Sequence
  Description of Artificial Sequence: Synthetic oligonucleotide
gaagactcgcgagtcttca

SEQ ID NO: 14749 - DNA, 19 bp, Artificial Sequence
  Description of Artificial Sequence: Synthetic oligonucleotide
gaagactcgcgagtcttct

SEQ ID NO: 14750 - DNA, 19 bp, Artificial Sequence
  Description of Artificial Sequence: Synthetic oligonucleotide
gaagactcgcgagtcttcc

SEQ ID NO: 14751 - DNA, 19 bp, Artificial Sequence
  Description of Artificial Sequence: Synthetic oligonucleotide
gaagactcgcgagtcttcg

SEQ ID NO: 14752 - DNA, 19 bp, Artificial Sequence
  Description of Artificial Sequence: Synthetic oligonucleotide
caagactcgcgagtcttga

SEQ ID NO: 14753 - DNA, 19 bp, Artificial Sequence
  Description of Artificial Sequence: Synthetic oligonucleotide
caagactcgcgagtcttgt

SEQ ID NO: 14754 - DNA, 19 bp, Artificial Sequence
  Description of Artificial Sequence: Synthetic oligonucleotide
caagactcgcgagtcttgc

SEQ ID NO: 14755 - DNA, 19 bp, Artificial Sequence
  Description of Artificial Sequence: Synthetic oligonucleotide
caagactcgcgagtcttgg

SEQ ID NO: 14756 - DNA, 19 bp, Artificial Sequence
  Description of Artificial Sequence: Synthetic oligonucleotide
tttgactcgcgagtcaaaa

SEQ ID NO: 14757 - DNA, 19 bp, Artificial Sequence
  Description of Artificial Sequence: Synthetic oligonucleotide
tttgactcgcgagtcaaat

SEQ ID NO: 14758 - DNA, 19 bp, Artificial Sequence
  Description of Artificial Sequence: Synthetic oligonucleotide
tttgactcgcgagtcaaac

SEQ ID NO: 14759 - DNA, 19 bp, Artificial Sequence
  Description of Artificial Sequence: Synthetic oligonucleotide
tttgactcgcgagtcaaag

SEQ ID NO: 14760 - DNA, 19 bp, Artificial Sequence
  Description of Artificial Sequence: Synthetic oligonucleotide
attgactcgcgagtcaata

SEQ ID NO: 14761 - DNA, 19 bp, Artificial Sequence
  Description of Artificial Sequence: Synthetic oligonucleotide
attgactcgcgagtcaatc

SEQ ID NO: 14762 - DNA, 19 bp, Artificial Sequence
  Description of Artificial Sequence: Synthetic oligonucleotide
attgactcgcgagtcaatg

SEQ ID NO: 14763 - DNA, 19 bp, Artificial Sequence
  Description of Artificial Sequence: Synthetic oligonucleotide
gttgactcgcgagtcaaca

SEQ ID NO: 14764 - DNA, 19 bp, Artificial Sequence
  Description of Artificial Sequence: Synthetic oligonucleotide
gttgactcgcgagtcaact

SEQ ID NO: 14765 - DNA, 19 bp, Artificial Sequence
  Description of Artificial Sequence: Synthetic oligonucleotide
gttgactcgcgagtcaacc

SEQ ID NO: 14766 - DNA, 19 bp, Artificial Sequence
  Description of Artificial Sequence: Synthetic oligonucleotide
gttgactcgcgagtcaacg

SEQ ID NO: 14767 - DNA, 19 bp, Artificial Sequence
  Description of Artificial Sequence: Synthetic oligonucleotide
cttgactcgcgagtcaaga

SEQ ID NO: 14768 - DNA, 19 bp, Artificial Sequence
  Description of Artificial Sequence: Synthetic oligonucleotide
cttgactcgcgagtcaagt

SEQ ID NO: 14769 - DNA, 19 bp, Artificial Sequence
  Description of Artificial Sequence: Synthetic oligonucleotide
cttgactcgcgagtcaagc

SEQ ID NO: 14770 - DNA, 19 bp, Artificial Sequence
  Description of Artificial Sequence: Synthetic oligonucleotide
cttgactcgcgagtcaagg

SEQ ID NO: 14771 - DNA, 19 bp, Artificial Sequence
  Description of Artificial Sequence: Synthetic oligonucleotide
aatgactcgcgagtcatta

SEQ ID NO: 14772 - DNA, 19 bp, Artificial Sequence
  Description of Artificial Sequence: Synthetic oligonucleotide
aatgactcgcgagtcattt

SEQ ID NO: 14773 - DNA, 19 bp, Artificial Sequence
  Description of Artificial Sequence: Synthetic oligonucleotide
aatgactcgcgagtcattc

SEQ ID NO: 14774 - DNA, 19 bp, Artificial Sequence
  Description of Artificial Sequence: Synthetic oligonucleotide
aatgactcgcgagtcattg

SEQ ID NO: 14775 - DNA, 19 bp, Artificial Sequence
  Description of Artificial Sequence: Synthetic oligonucleotide
gatgactcgcgagtcatca

SEQ ID NO: 14776 - DNA, 19 bp, Artificial Sequence
  Description of Artificial Sequence: Synthetic oligonucleotide
gatgactcgcgagtcatct

SEQ ID NO: 14777 - DNA, 19 bp, Artificial Sequence
  Description of Artificial Sequence: Synthetic oligonucleotide
gatgactcgcgagtcatcc

SEQ ID NO: 14778 - DNA, 19 bp, Artificial Sequence
  Description of Artificial Sequence: Synthetic oligonucleotide
gatgactcgcgagtcatcg

SEQ ID NO: 14779 - DNA, 19 bp, Artificial Sequence
  Description of Artificial Sequence: Synthetic oligonucleotide
catgactcgcgagtcatga

SEQ ID NO: 14780 - DNA, 19 bp, Artificial Sequence
  Description of Artificial Sequence: Synthetic oligonucleotide
catgactcgcgagtcatgt

SEQ ID NO: 14781 - DNA, 19 bp, Artificial Sequence
  Description of Artificial Sequence: Synthetic oligonucleotide
catgactcgcgagtcatgc

SEQ ID NO: 14782 - DNA, 19 bp, Artificial Sequence
  Description of Artificial Sequence: Synthetic oligonucleotide
catgactcgcgagtcatgg

SEQ ID NO: 14783 - DNA, 19 bp, Artificial Sequence
  Description of Artificial Sequence: Synthetic oligonucleotide
gtagactcgcgagtctaca

SEQ ID NO: 14784 - DNA, 19 bp, Artificial Sequence
  Description of Artificial Sequence: Synthetic oligonucleotide
gtagactcgcgagtctact

SEQ ID NO: 14785 - DNA, 19 bp, Artificial Sequence
  Description of Artificial Sequence: Synthetic oligonucleotide
gtagactcgcgagtctacc

SEQ ID NO: 14786 - DNA, 19 bp, Artificial Sequence
  Description of Artificial Sequence: Synthetic oligonucleotide
gtagactcgcgagtctacg

SEQ ID NO: 14787 - DNA, 19 bp, Artificial Sequence
  Description of Artificial Sequence: Synthetic oligonucleotide
ctagactcgcgagtctaga

SEQ ID NO: 14788 - DNA, 19 bp, Artificial Sequence
  Description of Artificial Sequence: Synthetic oligonucleotide
ctagactcgcgagtctagt

SEQ ID NO: 14789 - DNA, 19 bp, Artificial Sequence
  Description of Artificial Sequence: Synthetic oligonucleotide
ctagactcgcgagtctagc

SEQ ID NO: 14790 - DNA, 19 bp, Artificial Sequence
  Description of Artificial Sequence: Synthetic oligonucleotide
ctagactcgcgagtctagg

SEQ ID NO: 14791 - DNA, 19 bp, Artificial Sequence
  Description of Artificial Sequence: Synthetic oligonucleotide
tcagactccggagtctgaa

SEQ ID NO: 14792 - DNA, 19 bp, Artificial Sequence
  Description of Artificial Sequence: Synthetic oligonucleotide
tcagactccggagtctgat

SEQ ID NO: 14793 - DNA, 19 bp, Artificial Sequence
  Description of Artificial Sequence: Synthetic oligonucleotide
tcagactccggagtctgac

SEQ ID NO: 14794 - DNA, 19 bp, Artificial Sequence
  Description of Artificial Sequence: Synthetic oligonucleotide
tcagactccggagtctgag

SEQ ID NO: 14795 - DNA, 19 bp, Artificial Sequence
  Description of Artificial Sequence: Synthetic oligonucleotide
acagactccggagtctgta

SEQ ID NO: 14796 - DNA, 19 bp, Artificial Sequence
  Description of Artificial Sequence: Synthetic oligonucleotide
acagactccggagtctgtt

SEQ ID NO: 14797 - DNA, 19 bp, Artificial Sequence
  Description of Artificial Sequence: Synthetic oligonucleotide
acagactccggagtctgtc

SEQ ID NO: 14798 - DNA, 19 bp, Artificial Sequence
  Description of Artificial Sequence: Synthetic oligonucleotide
acagactccggagtctgtg

SEQ ID NO: 14799 - DNA, 19 bp, Artificial Sequence
  Description of Artificial Sequence: Synthetic oligonucleotide
gcagactccggagtctgct

SEQ ID NO: 14800 - DNA, 19 bp, Artificial Sequence
  Description of Artificial Sequence: Synthetic oligonucleotide
gcagactccggagtctgcc

SEQ ID NO: 14801 - DNA, 19 bp, Artificial Sequence
  Description of Artificial Sequence: Synthetic oligonucleotide
gcagactccggagtctgcg

SEQ ID NO: 14802 - DNA, 19 bp, Artificial Sequence
  Description of Artificial Sequence: Synthetic oligonucleotide
ccagactccggagtctgga

SEQ ID NO: 14803 - DNA, 19 bp, Artificial Sequence
  Description of Artificial Sequence: Synthetic oligonucleotide
ccagactccggagtctggt

SEQ ID NO: 14804 - DNA, 19 bp, Artificial Sequence
  Description of Artificial Sequence: Synthetic oligonucleotide
ccagactccggagtctggc

SEQ ID NO: 14805 - DNA, 19 bp, Artificial Sequence
  Description of Artificial Sequence: Synthetic oligonucleotide
ccagactccggagtctggg

SEQ ID NO: 14806 - DNA, 19 bp, Artificial Sequence
  Description of Artificial Sequence: Synthetic oligonucleotide
tctgactccggagtcagaa

SEQ ID NO: 14807 - DNA, 19 bp, Artificial Sequence
  Description of Artificial Sequence: Synthetic oligonucleotide
tctgactccggagtcagat

SEQ ID NO: 14808 - DNA, 19 bp, Artificial Sequence
  Description of Artificial Sequence: Synthetic oligonucleotide
tctgactccggagtcagac

SEQ ID NO: 14809 - DNA, 19 bp, Artificial Sequence
  Description of Artificial Sequence: Synthetic oligonucleotide
tctgactccggagtcagag

SEQ ID NO: 14810 - DNA, 19 bp, Artificial Sequence
  Description of Artificial Sequence: Synthetic oligonucleotide
actgactccggagtcagta

SEQ ID NO: 14811 - DNA, 19 bp, Artificial Sequence
  Description of Artificial Sequence: Synthetic oligonucleotide
actgactccggagtcagtt

SEQ ID NO: 14812 - DNA, 19 bp, Artificial Sequence
  Description of Artificial Sequence: Synthetic oligonucleotide
actgactccggagtcagtc

SEQ ID NO: 14813 - DNA, 19 bp, Artificial Sequence
  Description of Artificial Sequence: Synthetic oligonucleotide
actgactccggagtcagtg

SEQ ID NO: 14814 - DNA, 19 bp, Artificial Sequence
  Description of Artificial Sequence: Synthetic oligonucleotide
gctgactccggagtcagca

SEQ ID NO: 14815 - DNA, 19 bp, Artificial Sequence
  Description of Artificial Sequence: Synthetic oligonucleotide
gctgactccggagtcagcc

SEQ ID NO: 14816 - DNA, 19 bp, Artificial Sequence
  Description of Artificial Sequence: Synthetic oligonucleotide
gctgactccggagtcagcg

SEQ ID NO: 14817 - DNA, 19 bp, Artificial Sequence
  Description of Artificial Sequence: Synthetic oligonucleotide
cctgactccggagtcagga

SEQ ID NO: 14818 - DNA, 19 bp, Artificial Sequence
  Description of Artificial Sequence: Synthetic oligonucleotide
cctgactccggagtcaggt

SEQ ID NO: 14819 - DNA, 19 bp, Artificial Sequence
  Description of Artificial Sequence: Synthetic oligonucleotide
cctgactccggagtcaggc

SEQ ID NO: 14820 - DNA, 19 bp, Artificial Sequence
  Description of Artificial Sequence: Synthetic oligonucleotide
cctgactccggagtcaggg

SEQ ID NO: 14821 - DNA, 19 bp, Artificial Sequence
  Description of Artificial Sequence: Synthetic oligonucleotide
tacgactccggagtcgtaa

SEQ ID NO: 14822 - DNA, 19 bp, Artificial Sequence
  Description of Artificial Sequence: Synthetic oligonucleotide
tacgactccggagtcgtat

SEQ ID NO: 14823 - DNA, 19 bp, Artificial Sequence
  Description of Artificial Sequence: Synthetic oligonucleotide
tacgactccggagtcgtag

SEQ ID NO: 14824 - DNA, 19 bp, Artificial Sequence
  Description of Artificial Sequence: Synthetic oligonucleotide
aacgactccggagtcgtta

SEQ ID NO: 14825 - DNA, 19 bp, Artificial Sequence
  Description of Artificial Sequence: Synthetic oligonucleotide
aacgactccggagtcgttt

SEQ ID NO: 14826 - DNA, 19 bp, Artificial Sequence
  Description of Artificial Sequence: Synthetic oligonucleotide
aacgactccggagtcgttc

SEQ ID NO: 14827 - DNA, 19 bp, Artificial Sequence
  Description of Artificial Sequence: Synthetic oligonucleotide
aacgactccggagtcgttg

SEQ ID NO: 14828 - DNA, 19 bp, Artificial Sequence
  Description of Artificial Sequence: Synthetic oligonucleotide
gacgactccggagtcgtca

SEQ ID NO: 14829 - DNA, 19 bp, Artificial Sequence
  Description of Artificial Sequence: Synthetic oligonucleotide
gacgactccggagtcgtct

SEQ ID NO: 14830 - DNA, 19 bp, Artificial Sequence
  Description of Artificial Sequence: Synthetic oligonucleotide
gacgactccggagtcgtcc

SEQ ID NO: 14831 - DNA, 19 bp, Artificial Sequence
  Description of Artificial Sequence: Synthetic oligonucleotide
gacgactccggagtcgtcg

SEQ ID NO: 14832 - DNA, 19 bp, Artificial Sequence
  Description of Artificial Sequence: Synthetic oligonucleotide
cacgactccggagtcgtga

SEQ ID NO: 14833 - DNA, 19 bp, Artificial Sequence
  Description of Artificial Sequence: Synthetic oligonucleotide
cacgactccggagtcgtgt

SEQ ID NO: 14834 - DNA, 19 bp, Artificial Sequence
  Description of Artificial Sequence: Synthetic oligonucleotide
cacgactccggagtcgtgc

SEQ ID NO: 14835 - DNA, 19 bp, Artificial Sequence
  Description of Artificial Sequence: Synthetic oligonucleotide
cacgactccggagtcgtgg

SEQ ID NO: 14836 - DNA, 19 bp, Artificial Sequence
  Description of Artificial Sequence: Synthetic oligonucleotide
tccgactccggagtcggaa

SEQ ID NO: 14837 - DNA, 19 bp, Artificial Sequence
  Description of Artificial Sequence: Synthetic oligonucleotide
tccgactccggagtcggat

SEQ ID NO: 14838 - DNA, 19 bp, Artificial Sequence
  Description of Artificial Sequence: Synthetic oligonucleotide
tccgactccggagtcggac

SEQ ID NO: 14839 - DNA, 19 bp, Artificial Sequence
  Description of Artificial Sequence: Synthetic oligonucleotide
tccgactccggagtcggag

SEQ ID NO: 14840 - DNA, 19 bp, Artificial Sequence
  Description of Artificial Sequence: Synthetic oligonucleotide
accgactccggagtcggta

SEQ ID NO: 14841 - DNA, 19 bp, Artificial Sequence
  Description of Artificial Sequence: Synthetic oligonucleotide
accgactccggagtcggtt

SEQ ID NO: 14842 - DNA, 19 bp, Artificial Sequence
  Description of Artificial Sequence: Synthetic oligonucleotide
accgactccggagtcggtc

SEQ ID NO: 14843 - DNA, 19 bp, Artificial Sequence
  Description of Artificial Sequence: Synthetic oligonucleotide
accgactccggagtcggtg

SEQ ID NO: 14844 - DNA, 19 bp, Artificial Sequence
  Description of Artificial Sequence: Synthetic oligonucleotide
gccgactccggagtcggca

SEQ ID NO: 14845 - DNA, 19 bp, Artificial Sequence
  Description of Artificial Sequence: Synthetic oligonucleotide
gccgactccggagtcggct

SEQ ID NO: 14846 - DNA, 19 bp, Artificial Sequence
  Description of Artificial Sequence: Synthetic oligonucleotide
gccgactccggagtcggcg

SEQ ID NO: 14847 - DNA, 19 bp, Artificial Sequence
  Description of Artificial Sequence: Synthetic oligonucleotide
cccgactccggagtcggga

SEQ ID NO: 14848 - DNA, 19 bp, Artificial Sequence
  Description of Artificial Sequence: Synthetic oligonucleotide
cccgactccggagtcgggt

SEQ ID NO: 14849 - DNA, 19 bp, Artificial Sequence
  Description of Artificial Sequence: Synthetic oligonucleotide
cccgactccggagtcgggc

SEQ ID NO: 14850 - DNA, 19 bp, Artificial Sequence
  Description of Artificial Sequence: Synthetic oligonucleotide
tgagactccggagtctcaa

SEQ ID NO: 14851 - DNA, 19 bp, Artificial Sequence
  Description of Artificial Sequence: Synthetic oligonucleotide
tgagactccggagtctcat

SEQ ID NO: 14852 - DNA, 19 bp, Artificial Sequence
  Description of Artificial Sequence: Synthetic oligonucleotide
tgagactccggagtctcac

SEQ ID NO: 14853 - DNA, 19 bp, Artificial Sequence
  Description of Artificial Sequence: Synthetic oligonucleotide
tgagactccggagtctcag

SEQ ID NO: 14854 - DNA, 19 bp, Artificial Sequence
  Description of Artificial Sequence: Synthetic oligonucleotide
agagactccggagtctcta

SEQ ID NO: 14855 - DNA, 19 bp, Artificial Sequence
  Description of Artificial Sequence: Synthetic oligonucleotide
agagactccggagtctctt

SEQ ID NO: 14856 - DNA, 19 bp, Artificial Sequence
  Description of Artificial Sequence: Synthetic oligonucleotide
agagactccggagtctctc

SEQ ID NO: 14857 - DNA, 19 bp, Artificial Sequence
  Description of Artificial Sequence: Synthetic oligonucleotide
agagactccggagtctctg

SEQ ID NO: 14858 - DNA, 19 bp, Artificial Sequence
  Description of Artificial Sequence: Synthetic oligonucleotide
ggagactccggagtctcca

SEQ ID NO: 14859 - DNA, 19 bp, Artificial Sequence
  Description of Artificial Sequence: Synthetic oligonucleotide
ggagactccggagtctcct

SEQ ID NO: 14860 - DNA, 19 bp, Artificial Sequence
  Description of Artificial Sequence: Synthetic oligonucleotide
ggagactccggagtctccc

SEQ ID NO: 14861 - DNA, 19 bp, Artificial Sequence
  Description of Artificial Sequence: Synthetic oligonucleotide
ggagactccggagtctccg

SEQ ID NO: 14862 - DNA, 19 bp, Artificial Sequence
  Description of Artificial Sequence: Synthetic oligonucleotide
cgagactccggagtctcgt

SEQ ID NO: 14863 - DNA, 19 bp, Artificial Sequence
  Description of Artificial Sequence: Synthetic oligonucleotide
cgagactccggagtctcgc

SEQ ID NO: 14864 - DNA, 19 bp, Artificial Sequence
  Description of Artificial Sequence: Synthetic oligonucleotide
cgagactccggagtctcgg

SEQ ID NO: 14865 - DNA, 19 bp, Artificial Sequence
  Description of Artificial Sequence: Synthetic oligonucleotide
tgtgactccggagtcacaa

SEQ ID NO: 14866 - DNA, 19 bp, Artificial Sequence
  Description of Artificial Sequence: Synthetic oligonucleotide
tgtgactccggagtcacat

SEQ ID NO: 14867 - DNA, 19 bp, Artificial Sequence
  Description of Artificial Sequence: Synthetic oligonucleotide
tgtgactccggagtcacac

SEQ ID NO: 14868 - DNA, 19 bp, Artificial Sequence
  Description of Artificial Sequence: Synthetic oligonucleotide
tgtgactccggagtcacag

SEQ ID NO: 14869 - DNA, 19 bp, Artificial Sequence
  Description of Artificial Sequence: Synthetic oligonucleotide
agtgactccggagtcacta

SEQ ID NO: 14870 - DNA, 19 bp, Artificial Sequence
  Description of Artificial Sequence: Synthetic oligonucleotide
agtgactccggagtcactt

SEQ ID NO: 14871 - DNA, 19 bp, Artificial Sequence
  Description of Artificial Sequence: Synthetic oligonucleotide
agtgactccggagtcactc

SEQ ID NO: 14872 - DNA, 19 bp, Artificial Sequence
  Description of Artificial Sequence: Synthetic oligonucleotide
agtgactccggagtcactg

SEQ ID NO: 14873 - DNA, 19 bp, Artificial Sequence
  Description of Artificial Sequence: Synthetic oligonucleotide
ggtgactccggagtcacca

SEQ ID NO: 14874 - DNA, 19 bp, Artificial Sequence
  Description of Artificial Sequence: Synthetic oligonucleotide
ggtgactccggagtcacct

SEQ ID NO: 14875 - DNA, 19 bp, Artificial Sequence
  Description of Artificial Sequence: Synthetic oligonucleotide
ggtgactccggagtcaccc

SEQ ID NO: 14876 - DNA, 19 bp, Artificial Sequence
  Description of Artificial Sequence: Synthetic oligonucleotide
ggtgactccggagtcaccg

SEQ ID NO: 14877 - DNA, 19 bp, Artificial Sequence
  Description of Artificial Sequence: Synthetic oligonucleotide
cgtgactccggagtcacga

SEQ ID NO: 14878 - DNA, 19 bp, Artificial Sequence
  Description of Artificial Sequence: Synthetic oligonucleotide
cgtgactccggagtcacgc

SEQ ID NO: 14879 - DNA, 19 bp, Artificial Sequence
  Description of Artificial Sequence: Synthetic oligonucleotide
cgtgactccggagtcacgg

SEQ ID NO: 14880 - DNA, 19 bp, Artificial Sequence
  Description of Artificial Sequence: Synthetic oligonucleotide
taggactccggagtcctaa

SEQ ID NO: 14881 - DNA, 19 bp, Artificial Sequence
  Description of Artificial Sequence: Synthetic oligonucleotide
taggactccggagtcctat

SEQ ID NO: 14882 - DNA, 19 bp, Artificial Sequence
  Description of Artificial Sequence: Synthetic oligonucleotide
taggactccggagtcctac

SEQ ID NO: 14883 - DNA, 19 bp, Artificial Sequence
  Description of Artificial Sequence: Synthetic oligonucleotide
aaggactccggagtcctta

SEQ ID NO: 14884 - DNA, 19 bp, Artificial Sequence
  Description of Artificial Sequence: Synthetic oligonucleotide
aaggactccggagtccttt

SEQ ID NO: 14885 - DNA, 19 bp, Artificial Sequence
  Description of Artificial Sequence: Synthetic oligonucleotide
aaggactccggagtccttc

SEQ ID NO: 14886 - DNA, 19 bp, Artificial Sequence
  Description of Artificial Sequence: Synthetic oligonucleotide
aaggactccggagtccttg

SEQ ID NO: 14887 - DNA, 19 bp, Artificial Sequence
  Description of Artificial Sequence: Synthetic oligonucleotide
gaggactccggagtcctca

SEQ ID NO: 14888 - DNA, 19 bp, Artificial Sequence
  Description of Artificial Sequence: Synthetic oligonucleotide
gaggactccggagtcctct

SEQ ID NO: 14889 - DNA, 19 bp, Artificial Sequence
  Description of Artificial Sequence: Synthetic oligonucleotide
gaggactccggagtcctcc

SEQ ID NO: 14890 - DNA, 19 bp, Artificial Sequence
  Description of Artificial Sequence: Synthetic oligonucleotide
gaggactccggagtcctcg

SEQ ID NO: 14891 - DNA, 19 bp, Artificial Sequence
  Description of Artificial Sequence: Synthetic oligonucleotide
caggactccggagtcctga

SEQ ID NO: 14892 - DNA, 19 bp, Artificial Sequence
  Description of Artificial Sequence: Synthetic oligonucleotide
caggactccggagtcctgt

SEQ ID NO: 14893 - DNA, 19 bp, Artificial Sequence
  Description of Artificial Sequence: Synthetic oligonucleotide
caggactccggagtcctgc

SEQ ID NO: 14894 - DNA, 19 bp, Artificial Sequence
  Description of Artificial Sequence: Synthetic oligonucleotide
caggactccggagtcctgg

SEQ ID NO: 14895 - DNA, 19 bp, Artificial Sequence
  Description of Artificial Sequence: Synthetic oligonucleotide
ttggactccggagtccaaa

SEQ ID NO: 14896 - DNA, 19 bp, Artificial Sequence
  Description of Artificial Sequence: Synthetic oligonucleotide
ttggactccggagtccaat

SEQ ID NO: 14897 - DNA, 19 bp, Artificial Sequence
  Description of Artificial Sequence: Synthetic oligonucleotide
ttggactccggagtccaac

SEQ ID NO: 14898 - DNA, 19 bp, Artificial Sequence
  Description of Artificial Sequence: Synthetic oligonucleotide
ttggactccggagtccaag

SEQ ID NO: 14899 - DNA, 19 bp, Artificial Sequence
  Description of Artificial Sequence: Synthetic oligonucleotide
atggactccggagtccata

SEQ ID NO: 14900 - DNA, 19 bp, Artificial Sequence
  Description of Artificial Sequence: Synthetic oligonucleotide
atggactccggagtccatt

SEQ ID NO: 14901 - DNA, 19 bp, Artificial Sequence
  Description of Artificial Sequence: Synthetic oligonucleotide
atggactccggagtccatc

SEQ ID NO: 14902 - DNA, 19 bp, Artificial Sequence
  Description of Artificial Sequence: Synthetic oligonucleotide
gtggactccggagtccaca

SEQ ID NO: 14903 - DNA, 19 bp, Artificial Sequence
  Description of Artificial Sequence: Synthetic oligonucleotide
gtggactccggagtccact

SEQ ID NO: 14904 - DNA, 19 bp, Artificial Sequence
  Description of Artificial Sequence: Synthetic oligonucleotide
gtggactccggagtccacc

SEQ ID NO: 14905 - DNA, 19 bp, Artificial Sequence
  Description of Artificial Sequence: Synthetic oligonucleotide
gtggactccggagtccacg

SEQ ID NO: 14906 - DNA, 19 bp, Artificial Sequence
  Description of Artificial Sequence: Synthetic oligonucleotide
ctggactccggagtccaga

SEQ ID NO: 14907 - DNA, 19 bp, Artificial Sequence
  Description of Artificial Sequence: Synthetic oligonucleotide
ctggactccggagtccagt

SEQ ID NO: 14908 - DNA, 19 bp, Artificial Sequence
  Description of Artificial Sequence: Synthetic oligonucleotide
ctggactccggagtccagc

SEQ ID NO: 14909 - DNA, 19 bp, Artificial Sequence
  Description of Artificial Sequence: Synthetic oligonucleotide
ctggactccggagtccagg

SEQ ID NO: 14910 - DNA, 19 bp, Artificial Sequence
  Description of Artificial Sequence: Synthetic oligonucleotide
tgggactccggagtcccaa

SEQ ID NO: 14911 - DNA, 19 bp, Artificial Sequence
  Description of Artificial Sequence: Synthetic oligonucleotide
tgggactccggagtcccat

SEQ ID NO: 14912 - DNA, 19 bp, Artificial Sequence
  Description of Artificial Sequence: Synthetic oligonucleotide
tgggactccggagtcccac

SEQ ID NO: 14913 - DNA, 19 bp, Artificial Sequence
  Description of Artificial Sequence: Synthetic oligonucleotide
tgggactccggagtcccag

SEQ ID NO: 14914 - DNA, 19 bp, Artificial Sequence
  Description of Artificial Sequence: Synthetic oligonucleotide
agggactccggagtcccta

SEQ ID NO: 14915 - DNA, 19 bp, Artificial Sequence
  Description of Artificial Sequence: Synthetic oligonucleotide
agggactccggagtccctt

SEQ ID NO: 14916 - DNA, 19 bp, Artificial Sequence
  Description of Artificial Sequence: Synthetic oligonucleotide
agggactccggagtccctc

SEQ ID NO: 14917 - DNA, 19 bp, Artificial Sequence
  Description of Artificial Sequence: Synthetic oligonucleotide
agggactccggagtccctg

SEQ ID NO: 14918 - DNA, 19 bp, Artificial Sequence
  Description of Artificial Sequence: Synthetic oligonucleotide
ggggactccggagtcccca

SEQ ID NO: 14919 - DNA, 19 bp, Artificial Sequence
  Description of Artificial Sequence: Synthetic oligonucleotide
ggggactccggagtcccct

SEQ ID NO: 14920 - DNA, 19 bp, Artificial Sequence
  Description of Artificial Sequence: Synthetic oligonucleotide
ggggactccggagtccccg

SEQ ID NO: 14921 - DNA, 19 bp, Artificial Sequence
  Description of Artificial Sequence: Synthetic oligonucleotide
cgggactccggagtcccga

SEQ ID NO: 14922 - DNA, 19 bp, Artificial Sequence
  Description of Artificial Sequence: Synthetic oligonucleotide
cgggactccggagtcccgt

SEQ ID NO: 14923 - DNA, 19 bp, Artificial Sequence
  Description of Artificial Sequence: Synthetic oligonucleotide
cgggactccggagtcccgc

SEQ ID NO: 14924 - DNA, 19 bp, Artificial Sequence
  Description of Artificial Sequence: Synthetic oligonucleotide
gaagactccggagtcttca

SEQ ID NO: 14925 - DNA, 19 bp, Artificial Sequence
  Description of Artificial Sequence: Synthetic oligonucleotide
gaagactccggagtcttct

SEQ ID NO: 14926 - DNA, 19 bp, Artificial Sequence
  Description of Artificial Sequence: Synthetic oligonucleotide
gaagactccggagtcttcc

SEQ ID NO: 14927 - DNA, 19 bp, Artificial Sequence
  Description of Artificial Sequence: Synthetic oligonucleotide
gaagactccggagtcttcg

SEQ ID NO: 14928 - DNA, 19 bp, Artificial Sequence
  Description of Artificial Sequence: Synthetic oligonucleotide
caagactccggagtcttga

SEQ ID NO: 14929 - DNA, 19 bp, Artificial Sequence
  Description of Artificial Sequence: Synthetic oligonucleotide
caagactccggagtcttgt

SEQ ID NO: 14930 - DNA, 19 bp, Artificial Sequence
  Description of Artificial Sequence: Synthetic oligonucleotide
caagactccggagtcttgc

SEQ ID NO: 14931 - DNA, 19 bp, Artificial Sequence
  Description of Artificial Sequence: Synthetic oligonucleotide
caagactccggagtcttgg

SEQ ID NO: 14932 - DNA, 19 bp, Artificial Sequence
  Description of Artificial Sequence: Synthetic oligonucleotide
tttgactccggagtcaaaa

SEQ ID NO: 14933 - DNA, 19 bp, Artificial Sequence
  Description of Artificial Sequence: Synthetic oligonucleotide
tttgactccggagtcaaat

SEQ ID NO: 14934 - DNA, 19 bp, Artificial Sequence
  Description of Artificial Sequence: Synthetic oligonucleotide
tttgactccggagtcaaac

SEQ ID NO: 14935 - DNA, 19 bp, Artificial Sequence
  Description of Artificial Sequence: Synthetic oligonucleotide
tttgactccggagtcaaag

SEQ ID NO: 14936 - DNA, 19 bp, Artificial Sequence
  Description of Artificial Sequence: Synthetic oligonucleotide
attgactccggagtcaata

SEQ ID NO: 14937 - DNA, 19 bp, Artificial Sequence
  Description of Artificial Sequence: Synthetic oligonucleotide
attgactccggagtcaatc

SEQ ID NO: 14938 - DNA, 19 bp, Artificial Sequence
  Description of Artificial Sequence: Synthetic oligonucleotide
attgactccggagtcaatg

SEQ ID NO: 14939 - DNA, 19 bp, Artificial Sequence
  Description of Artificial Sequence: Synthetic oligonucleotide
gttgactccggagtcaaca

SEQ ID NO: 14940 - DNA, 19 bp, Artificial Sequence
  Description of Artificial Sequence: Synthetic oligonucleotide
gttgactccggagtcaact

SEQ ID NO: 14941 - DNA, 19 bp, Artificial Sequence
  Description of Artificial Sequence: Synthetic oligonucleotide
gttgactccggagtcaacc

SEQ ID NO: 14942 - DNA, 19 bp, Artificial Sequence
  Description of Artificial Sequence: Synthetic oligonucleotide
gttgactccggagtcaacg

SEQ ID NO: 14943 - DNA, 19 bp, Artificial Sequence
  Description of Artificial Sequence: Synthetic oligonucleotide
cttgactccggagtcaaga

SEQ ID NO: 14944 - DNA, 19 bp, Artificial Sequence
  Description of Artificial Sequence: Synthetic oligonucleotide
cttgactccggagtcaagt

SEQ ID NO: 14945 - DNA, 19 bp, Artificial Sequence
  Description of Artificial Sequence: Synthetic oligonucleotide
cttgactccggagtcaagc

SEQ ID NO: 14946 - DNA, 19 bp, Artificial Sequence
  Description of Artificial Sequence: Synthetic oligonucleotide
cttgactccggagtcaagg

SEQ ID NO: 14947 - DNA, 19 bp, Artificial Sequence
  Description of Artificial Sequence: Synthetic oligonucleotide
aatgactccggagtcatta

SEQ ID NO: 14948 - DNA, 19 bp, Artificial Sequence
  Description of Artificial Sequence: Synthetic oligonucleotide
aatgactccggagtcattt

SEQ ID NO: 14949 - DNA, 19 bp, Artificial Sequence
  Description of Artificial Sequence: Synthetic oligonucleotide
aatgactccggagtcattc

SEQ ID NO: 14950 - DNA, 19 bp, Artificial Sequence
  Description of Artificial Sequence: Synthetic oligonucleotide
aatgactccggagtcattg

SEQ ID NO: 14951 - DNA, 19 bp, Artificial Sequence
  Description of Artificial Sequence: Synthetic oligonucleotide
gatgactccggagtcatca

SEQ ID NO: 14952 - DNA, 19 bp, Artificial Sequence
  Description of Artificial Sequence: Synthetic oligonucleotide
gatgactccggagtcatct

SEQ ID NO: 14953 - DNA, 19 bp, Artificial Sequence
  Description of Artificial Sequence: Synthetic oligonucleotide
gatgactccggagtcatcc

SEQ ID NO: 14954 - DNA, 19 bp, Artificial Sequence
  Description of Artificial Sequence: Synthetic oligonucleotide
gatgactccggagtcatcg

SEQ ID NO: 14955 - DNA, 19 bp, Artificial Sequence
  Description of Artificial Sequence: Synthetic oligonucleotide
catgactccggagtcatga

SEQ ID NO: 14956 - DNA, 19 bp, Artificial Sequence
  Description of Artificial Sequence: Synthetic oligonucleotide
catgactccggagtcatgt

SEQ ID NO: 14957 - DNA, 19 bp, Artificial Sequence
  Description of Artificial Sequence: Synthetic oligonucleotide
catgactccggagtcatgc

SEQ ID NO: 14958 - DNA, 19 bp, Artificial Sequence
  Description of Artificial Sequence: Synthetic oligonucleotide
catgactccggagtcatgg

SEQ ID NO: 14959 - DNA, 19 bp, Artificial Sequence
  Description of Artificial Sequence: Synthetic oligonucleotide
gtagactccggagtctaca

SEQ ID NO: 14960 - DNA, 19 bp, Artificial Sequence
  Description of Artificial Sequence: Synthetic oligonucleotide
gtagactccggagtctact

SEQ ID NO: 14961 - DNA, 19 bp, Artificial Sequence
  Description of Artificial Sequence: Synthetic oligonucleotide
gtagactccggagtctacc

SEQ ID NO: 14962 - DNA, 19 bp, Artificial Sequence
  Description of Artificial Sequence: Synthetic oligonucleotide
gtagactccggagtctacg

SEQ ID NO: 14963 - DNA, 19 bp, Artificial Sequence
  Description of Artificial Sequence: Synthetic oligonucleotide
ctagactccggagtctaga

SEQ ID NO: 14964 - DNA, 19 bp, Artificial Sequence
  Description of Artificial Sequence: Synthetic oligonucleotide
ctagactccggagtctagt

SEQ ID NO: 14965 - DNA, 19 bp, Artificial Sequence
  Description of Artificial Sequence: Synthetic oligonucleotide
ctagactccggagtctagc

SEQ ID NO: 14966 - DNA, 19 bp, Artificial Sequence
  Description of Artificial Sequence: Synthetic oligonucleotide
ctagactccggagtctagg

SEQ ID NO: 14967 - DNA, 19 bp, Artificial Sequence
  Description of Artificial Sequence: Synthetic oligonucleotide
gcagactcatgagtctgct

SEQ ID NO: 14968 - DNA, 19 bp, Artificial Sequence
  Description of Artificial Sequence: Synthetic oligonucleotide
gcagactcatgagtctgcc

SEQ ID NO: 14969 - DNA, 19 bp, Artificial Sequence
  Description of Artificial Sequence: Synthetic oligonucleotide
gcagactcatgagtctgcg

SEQ ID NO: 14970 - DNA, 19 bp, Artificial Sequence
  Description of Artificial Sequence: Synthetic oligonucleotide
ccagactcatgagtctgga

SEQ ID NO: 14971 - DNA, 19 bp, Artificial Sequence
  Description of Artificial Sequence: Synthetic oligonucleotide
ccagactcatgagtctggt

SEQ ID NO: 14972 - DNA, 19 bp, Artificial Sequence
  Description of Artificial Sequence: Synthetic oligonucleotide
ccagactcatgagtctggc

SEQ ID NO: 14973 - DNA, 19 bp, Artificial Sequence
  Description of Artificial Sequence: Synthetic oligonucleotide
ccagactcatgagtctggg

SEQ ID NO: 14974 - DNA, 19 bp, Artificial Sequence
  Description of Artificial Sequence: Synthetic oligonucleotide
gctgactcatgagtcagca

SEQ ID NO: 14975 - DNA, 19 bp, Artificial Sequence
  Description of Artificial Sequence: Synthetic oligonucleotide
gctgactcatgagtcagcc

SEQ ID NO: 14976 - DNA, 19 bp, Artificial Sequence
  Description of Artificial Sequence: Synthetic oligonucleotide
gctgactcatgagtcagcg

SEQ ID NO: 14977 - DNA, 19 bp, Artificial Sequence
  Description of Artificial Sequence: Synthetic oligonucleotide
cctgactcatgagtcagga

SEQ ID NO: 14978 - DNA, 19 bp, Artificial Sequence
  Description of Artificial Sequence: Synthetic oligonucleotide
cctgactcatgagtcaggt

SEQ ID NO: 14979 - DNA, 19 bp, Artificial Sequence
  Description of Artificial Sequence: Synthetic oligonucleotide
cctgactcatgagtcaggc

SEQ ID NO: 14980 - DNA, 19 bp, Artificial Sequence
  Description of Artificial Sequence: Synthetic oligonucleotide
cctgactcatgagtcaggg

SEQ ID NO: 14981 - DNA, 19 bp, Artificial Sequence
  Description of Artificial Sequence: Synthetic oligonucleotide
aacgactcatgagtcgtta

SEQ ID NO: 14982 - DNA, 19 bp, Artificial Sequence
  Description of Artificial Sequence: Synthetic oligonucleotide
aacgactcatgagtcgttt

SEQ ID NO: 14983 - DNA, 19 bp, Artificial Sequence
  Description of Artificial Sequence: Synthetic oligonucleotide
aacgactcatgagtcgttc

SEQ ID NO: 14984 - DNA, 19 bp, Artificial Sequence
  Description of Artificial Sequence: Synthetic oligonucleotide
aacgactcatgagtcgttg

SEQ ID NO: 14985 - DNA, 19 bp, Artificial Sequence
  Description of Artificial Sequence: Synthetic oligonucleotide
gacgactcatgagtcgtca

SEQ ID NO: 14986 - DNA, 19 bp, Artificial Sequence
  Description of Artificial Sequence: Synthetic oligonucleotide
gacgactcatgagtcgtct

SEQ ID NO: 14987 - DNA, 19 bp, Artificial Sequence
  Description of Artificial Sequence: Synthetic oligonucleotide
gacgactcatgagtcgtcc

SEQ ID NO: 14988 - DNA, 19 bp, Artificial Sequence
  Description of Artificial Sequence: Synthetic oligonucleotide
gacgactcatgagtcgtcg

SEQ ID NO: 14989 - DNA, 19 bp, Artificial Sequence
  Description of Artificial Sequence: Synthetic oligonucleotide
cacgactcatgagtcgtga

SEQ ID NO: 14990 - DNA, 19 bp, Artificial Sequence
  Description of Artificial Sequence: Synthetic oligonucleotide
cacgactcatgagtcgtgt

SEQ ID NO: 14991 - DNA, 19 bp, Artificial Sequence
  Description of Artificial Sequence: Synthetic oligonucleotide
cacgactcatgagtcgtgc

SEQ ID NO: 14992 - DNA, 19 bp, Artificial Sequence
  Description of Artificial Sequence: Synthetic oligonucleotide
cacgactcatgagtcgtgg

SEQ ID NO: 14993 - DNA, 19 bp, Artificial Sequence
  Description of Artificial Sequence: Synthetic oligonucleotide
tccgactcatgagtcggaa

SEQ ID NO: 14994 - DNA, 19 bp, Artificial Sequence
  Description of Artificial Sequence: Synthetic oligonucleotide
tccgactcatgagtcggat

SEQ ID NO: 14995 - DNA, 19 bp, Artificial Sequence
  Description of Artificial Sequence: Synthetic oligonucleotide
tccgactcatgagtcggac

SEQ ID NO: 14996 - DNA, 19 bp, Artificial Sequence
  Description of Artificial Sequence: Synthetic oligonucleotide
tccgactcatgagtcggag

SEQ ID NO: 14997 - DNA, 19 bp, Artificial Sequence
  Description of Artificial Sequence: Synthetic oligonucleotide
accgactcatgagtcggta

SEQ ID NO: 14998 - DNA, 19 bp, Artificial Sequence
  Description of Artificial Sequence: Synthetic oligonucleotide
accgactcatgagtcggtt

SEQ ID NO: 14999 - DNA, 19 bp, Artificial Sequence
  Description of Artificial Sequence: Synthetic oligonucleotide
accgactcatgagtcggtc

SEQ ID NO: 15000 - DNA, 19 bp, Artificial Sequence
  Description of Artificial Sequence: Synthetic oligonucleotide
accgactcatgagtcggtg

SEQ ID NO: 15001 - DNA, 19 bp, Artificial Sequence
  Description of Artificial Sequence: Synthetic oligonucleotide
gccgactcatgagtcggca

SEQ ID NO: 15002 - DNA, 19 bp, Artificial Sequence
  Description of Artificial Sequence: Synthetic oligonucleotide
gccgactcatgagtcggct

SEQ ID NO: 15003 - DNA, 19 bp, Artificial Sequence
  Description of Artificial Sequence: Synthetic oligonucleotide
gccgactcatgagtcggcg

SEQ ID NO: 15004 - DNA, 19 bp, Artificial Sequence
  Description of Artificial Sequence: Synthetic oligonucleotide
cccgactcatgagtcggga

SEQ ID NO: 15005 - DNA, 19 bp, Artificial Sequence
  Description of Artificial Sequence: Synthetic oligonucleotide
cccgactcatgagtcgggt

SEQ ID NO: 15006 - DNA, 19 bp, Artificial Sequence
  Description of Artificial Sequence: Synthetic oligonucleotide
cccgactcatgagtcgggc

SEQ ID NO: 15007 - DNA, 19 bp, Artificial Sequence
  Description of Artificial Sequence: Synthetic oligonucleotide
ggagactcatgagtctcca

SEQ ID NO: 15008 - DNA, 19 bp, Artificial Sequence
  Description of Artificial Sequence: Synthetic oligonucleotide
ggagactcatgagtctcct

SEQ ID NO: 15009 - DNA, 19 bp, Artificial Sequence
  Description of Artificial Sequence: Synthetic oligonucleotide
ggagactcatgagtctccc

SEQ ID NO: 15010 - DNA, 19 bp, Artificial Sequence
  Description of Artificial Sequence: Synthetic oligonucleotide
ggagactcatgagtctccg

SEQ ID NO: 15011 - DNA, 19 bp, Artificial Sequence
  Description of Artificial Sequence: Synthetic oligonucleotide
cgagactcatgagtctcgt

SEQ ID NO: 15012 - DNA, 19 bp, Artificial Sequence
  Description of Artificial Sequence: Synthetic oligonucleotide
cgagactcatgagtctcgc

SEQ ID NO: 15013 - DNA, 19 bp, Artificial Sequence
  Description of Artificial Sequence: Synthetic oligonucleotide
cgagactcatgagtctcgg

SEQ ID NO: 15014 - DNA, 19 bp, Artificial Sequence
  Description of Artificial Sequence: Synthetic oligonucleotide
ggtgactcatgagtcacca

SEQ ID NO: 15015 - DNA, 19 bp, Artificial Sequence
  Description of Artificial Sequence: Synthetic oligonucleotide
ggtgactcatgagtcacct

SEQ ID NO: 15016 - DNA, 19 bp, Artificial Sequence
  Description of Artificial Sequence: Synthetic oligonucleotide
ggtgactcatgagtcaccc

SEQ ID NO: 15017 - DNA, 19 bp, Artificial Sequence
  Description of Artificial Sequence: Synthetic oligonucleotide
ggtgactcatgagtcaccg

SEQ ID NO: 15018 - DNA, 19 bp, Artificial Sequence
  Description of Artificial Sequence: Synthetic oligonucleotide
cgtgactcatgagtcacga

SEQ ID NO: 15019 - DNA, 19 bp, Artificial Sequence
  Description of Artificial Sequence: Synthetic oligonucleotide
cgtgactcatgagtcacgc

SEQ ID NO: 15020 - DNA, 19 bp, Artificial Sequence
  Description of Artificial Sequence: Synthetic oligonucleotide
cgtgactcatgagtcacgg

SEQ ID NO: 15021 - DNA, 19 bp, Artificial Sequence
  Description of Artificial Sequence: Synthetic oligonucleotide
gaggactcatgagtcctca

SEQ ID NO: 15022 - DNA, 19 bp, Artificial Sequence
  Description of Artificial Sequence: Synthetic oligonucleotide
gaggactcatgagtcctct

SEQ ID NO: 15023 - DNA, 19 bp, Artificial Sequence
  Description of Artificial Sequence: Synthetic oligonucleotide
gaggactcatgagtcctcc

SEQ ID NO: 15024 - DNA, 19 bp, Artificial Sequence
  Description of Artificial Sequence: Synthetic oligonucleotide
gaggactcatgagtcctcg

SEQ ID NO: 15025 - DNA, 19 bp, Artificial Sequence
  Description of Artificial Sequence: Synthetic oligonucleotide
caggactcatgagtcctga

SEQ ID NO: 15026 - DNA, 19 bp, Artificial Sequence
  Description of Artificial Sequence: Synthetic oligonucleotide
caggactcatgagtcctgt

SEQ ID NO: 15027 - DNA, 19 bp, Artificial Sequence
  Description of Artificial Sequence: Synthetic oligonucleotide
caggactcatgagtcctgc

SEQ ID NO: 15028 - DNA, 19 bp, Artificial Sequence
  Description of Artificial Sequence: Synthetic oligonucleotide
caggactcatgagtcctgg

SEQ ID NO: 15029 - DNA, 19 bp, Artificial Sequence
  Description of Artificial Sequence: Synthetic oligonucleotide
gtggactcatgagtccaca

SEQ ID NO: 15030 - DNA, 19 bp, Artificial Sequence
  Description of Artificial Sequence: Synthetic oligonucleotide
gtggactcatgagtccact

SEQ ID NO: 15031 - DNA, 19 bp, Artificial Sequence
  Description of Artificial Sequence: Synthetic oligonucleotide
gtggactcatgagtccacc

SEQ ID NO: 15032 - DNA, 19 bp, Artificial Sequence
  Description of Artificial Sequence: Synthetic oligonucleotide
gtggactcatgagtccacg

SEQ ID NO: 15033 - DNA, 19 bp, Artificial Sequence
  Description of Artificial Sequence: Synthetic oligonucleotide
ctggactcatgagtccaga

SEQ ID NO: 15034 - DNA, 19 bp, Artificial Sequence
  Description of Artificial Sequence: Synthetic oligonucleotide
ctggactcatgagtccagt

SEQ ID NO: 15035 - DNA, 19 bp, Artificial Sequence
  Description of Artificial Sequence: Synthetic oligonucleotide
ctggactcatgagtccagc

SEQ ID NO: 15036 - DNA, 19 bp, Artificial Sequence
  Description of Artificial Sequence: Synthetic oligonucleotide
ctggactcatgagtccagg

SEQ ID NO: 15037 - DNA, 19 bp, Artificial Sequence
  Description of Artificial Sequence: Synthetic oligonucleotide
tgggactcatgagtcccaa

SEQ ID NO: 15038 - DNA, 19 bp, Artificial Sequence
  Description of Artificial Sequence: Synthetic oligonucleotide
tgggactcatgagtcccat

SEQ ID NO: 15039 - DNA, 19 bp, Artificial Sequence
  Description of Artificial Sequence: Synthetic oligonucleotide
tgggactcatgagtcccac

SEQ ID NO: 15040 - DNA, 19 bp, Artificial Sequence
  Description of Artificial Sequence: Synthetic oligonucleotide
tgggactcatgagtcccag

SEQ ID NO: 15041 - DNA, 19 bp, Artificial Sequence
  Description of Artificial Sequence: Synthetic oligonucleotide
agggactcatgagtcccta

SEQ ID NO: 15042 - DNA, 19 bp, Artificial Sequence
  Description of Artificial Sequence: Synthetic oligonucleotide
agggactcatgagtccctt

SEQ ID NO: 15043 - DNA, 19 bp, Artificial Sequence
  Description of Artificial Sequence: Synthetic oligonucleotide
agggactccggagtccctc

SEQ ID NO: 15044 - DNA, 19 bp, Artificial Sequence
  Description of Artificial Sequence: Synthetic oligonucleotide
agggactcatgagtccctg

SEQ ID NO: 15045 - DNA, 19 bp, Artificial Sequence
  Description of Artificial Sequence: Synthetic oligonucleotide
ggggactcatgagtcccca

SEQ ID NO: 15046 - DNA, 19 bp, Artificial Sequence
  Description of Artificial Sequence: Synthetic oligonucleotide
ggggactcatgagtcccct

SEQ ID NO: 15047 - DNA, 19 bp, Artificial Sequence
  Description of Artificial Sequence: Synthetic oligonucleotide
ggggactcatgagtccccg

SEQ ID NO: 15048 - DNA, 19 bp, Artificial Sequence
  Description of Artificial Sequence: Synthetic oligonucleotide
cgggactcatgagtcccga

SEQ ID NO: 15049 - DNA, 19 bp, Artificial Sequence
  Description of Artificial Sequence: Synthetic oligonucleotide
cgggactcatgagtcccgt

SEQ ID NO: 15050 - DNA, 19 bp, Artificial Sequence
  Description of Artificial Sequence: Synthetic oligonucleotide
cgggactcatgagtcccgc

SEQ ID NO: 15051 - DNA, 19 bp, Artificial Sequence
  Description of Artificial Sequence: Synthetic oligonucleotide
gcagactctagagtctgct

SEQ ID NO: 15052 - DNA, 19 bp, Artificial Sequence
  Description of Artificial Sequence: Synthetic oligonucleotide
gcagactctagagtctgcc

SEQ ID NO: 15053 - DNA, 19 bp, Artificial Sequence
  Description of Artificial Sequence: Synthetic oligonucleotide
gcagactctagagtctgcg

SEQ ID NO: 15054 - DNA, 19 bp, Artificial Sequence
  Description of Artificial Sequence: Synthetic oligonucleotide
ccagactctagagtctgga

SEQ ID NO: 15055 - DNA, 19 bp, Artificial Sequence
  Description of Artificial Sequence: Synthetic oligonucleotide
ccagactctagagtctggt

SEQ ID NO: 15056 - DNA, 19 bp, Artificial Sequence
  Description of Artificial Sequence: Synthetic oligonucleotide
ccagactctagagtctggc

SEQ ID NO: 15057 - DNA, 19 bp, Artificial Sequence
  Description of Artificial Sequence: Synthetic oligonucleotide
ccagactctagagtctggg

SEQ ID NO: 15058 - DNA, 19 bp, Artificial Sequence
  Description of Artificial Sequence: Synthetic oligonucleotide
gctgactctagagtcagca

SEQ ID NO: 15059 - DNA, 19 bp, Artificial Sequence
  Description of Artificial Sequence: Synthetic oligonucleotide
gctgactctagagtcagcc

SEQ ID NO: 15060 - DNA, 19 bp, Artificial Sequence
  Description of Artificial Sequence: Synthetic oligonucleotide
gctgactctagagtcagcg

SEQ ID NO: 15061 - DNA, 19 bp, Artificial Sequence
  Description of Artificial Sequence: Synthetic oligonucleotide
cctgactctagagtcagga

SEQ ID NO: 15062 - DNA, 19 bp, Artificial Sequence
  Description of Artificial Sequence: Synthetic oligonucleotide
cctgactctagagtcaggt

SEQ ID NO: 15063 - DNA, 19 bp, Artificial Sequence
  Description of Artificial Sequence: Synthetic oligonucleotide
cctgactctagagtcaggc

SEQ ID NO: 15064 - DNA, 19 bp, Artificial Sequence
  Description of Artificial Sequence: Synthetic oligonucleotide
cctgactctagagtcaggg

SEQ ID NO: 15065 - DNA, 19 bp, Artificial Sequence
  Description of Artificial Sequence: Synthetic oligonucleotide
gacgactctagagtcgtca

SEQ ID NO: 15066 - DNA, 19 bp, Artificial Sequence
  Description of Artificial Sequence: Synthetic oligonucleotide
gacgactctagagtcgtct

SEQ ID NO: 15067 - DNA, 19 bp, Artificial Sequence
  Description of Artificial Sequence: Synthetic oligonucleotide
gacgactctagagtcgtcc

SEQ ID NO: 15068 - DNA, 19 bp, Artificial Sequence
  Description of Artificial Sequence: Synthetic oligonucleotide
gacgactctagagtcgtcg

SEQ ID NO: 15069 - DNA, 19 bp, Artificial Sequence
  Description of Artificial Sequence: Synthetic oligonucleotide
cacgactctagagtcgtga

SEQ ID NO: 15070 - DNA, 19 bp, Artificial Sequence
  Description of Artificial Sequence: Synthetic oligonucleotide
cacgactctagagtcgtgt

SEQ ID NO: 15071 - DNA, 19 bp, Artificial Sequence
  Description of Artificial Sequence: Synthetic oligonucleotide
cacgactctagagtcgtgc

SEQ ID NO: 15072 - DNA, 19 bp, Artificial Sequence
  Description of Artificial Sequence: Synthetic oligonucleotide
cacgactctagagtcgtgg

SEQ ID NO: 15073 - DNA, 19 bp, Artificial Sequence
  Description of Artificial Sequence: Synthetic oligonucleotide
tccgactctagagtcggaa

SEQ ID NO: 15074 - DNA, 19 bp, Artificial Sequence
  Description of Artificial Sequence: Synthetic oligonucleotide
tccgactctagagtcggat

SEQ ID NO: 15075 - DNA, 19 bp, Artificial Sequence
  Description of Artificial Sequence: Synthetic oligonucleotide
tccgactctagagtcggac

SEQ ID NO: 15076 - DNA, 19 bp, Artificial Sequence
  Description of Artificial Sequence: Synthetic oligonucleotide
tccgactctagagtcggag

SEQ ID NO: 15077 - DNA, 19 bp, Artificial Sequence
  Description of Artificial Sequence: Synthetic oligonucleotide
accgactctagagtcggta

SEQ ID NO: 15078 - DNA, 19 bp, Artificial Sequence
  Description of Artificial Sequence: Synthetic oligonucleotide
accgactctagagtcggtt

SEQ ID NO: 15079 - DNA, 19 bp, Artificial Sequence
  Description of Artificial Sequence: Synthetic oligonucleotide
accgactctagagtcggtc

SEQ ID NO: 15080 - DNA, 19 bp, Artificial Sequence
  Description of Artificial Sequence: Synthetic oligonucleotide
accgactctagagtcggtg

SEQ ID NO: 15081 - DNA, 19 bp, Artificial Sequence
  Description of Artificial Sequence: Synthetic oligonucleotide
gccgactctagagtcggca

SEQ ID NO: 15082 - DNA, 19 bp, Artificial Sequence
  Description of Artificial Sequence: Synthetic oligonucleotide
gccgactctagagtcggct

SEQ ID NO: 15083 - DNA, 19 bp, Artificial Sequence
  Description of Artificial Sequence: Synthetic oligonucleotide
gccgactctagagtcggcg

SEQ ID NO: 15084 - DNA, 19 bp, Artificial Sequence
  Description of Artificial Sequence: Synthetic oligonucleotide
cccgactctagagtcggga

SEQ ID NO: 15085 - DNA, 19 bp, Artificial Sequence
  Description of Artificial Sequence: Synthetic oligonucleotide
cccgactctagagtcgggt

SEQ ID NO: 15086 - DNA, 19 bp, Artificial Sequence
  Description of Artificial Sequence: Synthetic oligonucleotide
cccgactctagagtcgggc

SEQ ID NO: 15087 - DNA, 19 bp, Artificial Sequence
  Description of Artificial Sequence: Synthetic oligonucleotide
ggagactctagagtctcca

SEQ ID NO: 15088 - DNA, 19 bp, Artificial Sequence
  Description of Artificial Sequence: Synthetic oligonucleotide
ggagactctagagtctcct

SEQ ID NO: 15089 - DNA, 19 bp, Artificial Sequence
  Description of Artificial Sequence: Synthetic oligonucleotide
ggagactctagagtctccc

SEQ ID NO: 15090 - DNA, 19 bp, Artificial Sequence
  Description of Artificial Sequence: Synthetic oligonucleotide
ggagactctagagtctccg

SEQ ID NO: 15091 - DNA, 19 bp, Artificial Sequence
  Description of Artificial Sequence: Synthetic oligonucleotide
cgagactctagagtctcgt

SEQ ID NO: 15092 - DNA, 19 bp, Artificial Sequence
  Description of Artificial Sequence: Synthetic oligonucleotide
cgagactctagagtctcgc

SEQ ID NO: 15093 - DNA, 19 bp, Artificial Sequence
  Description of Artificial Sequence: Synthetic oligonucleotide
cgagactctagagtctcgg

SEQ ID NO: 15094 - DNA, 19 bp, Artificial Sequence
  Description of Artificial Sequence: Synthetic oligonucleotide
ggtgactctagagtcacca

SEQ ID NO: 15095 - DNA, 19 bp, Artificial Sequence
  Description of Artificial Sequence: Synthetic oligonucleotide
ggtgactctagagtcacct

SEQ ID NO: 15096 - DNA, 19 bp, Artificial Sequence
  Description of Artificial Sequence: Synthetic oligonucleotide
ggtgactctagagtcaccc

SEQ ID NO: 15097 - DNA, 19 bp, Artificial Sequence
  Description of Artificial Sequence: Synthetic oligonucleotide
ggtgactctagagtcaccg

SEQ ID NO: 15098 - DNA, 19 bp, Artificial Sequence
  Description of Artificial Sequence: Synthetic oligonucleotide
cgtgactctagagtcacga

SEQ ID NO: 15099 - DNA, 19 bp, Artificial Sequence
  Description of Artificial Sequence: Synthetic oligonucleotide
cgtgactctagagtcacgc

SEQ ID NO: 15100 - DNA, 19 bp, Artificial Sequence
  Description of Artificial Sequence: Synthetic oligonucleotide
cgtgactctagagtcacgg

SEQ ID NO: 15101 - DNA, 19 bp, Artificial Sequence
  Description of Artificial Sequence: Synthetic oligonucleotide
gaggactctagagtcctca

SEQ ID NO: 15102 - DNA, 19 bp, Artificial Sequence
  Description of Artificial Sequence: Synthetic oligonucleotide
gaggactctagagtcctct

SEQ ID NO: 15103 - DNA, 19 bp, Artificial Sequence
  Description of Artificial Sequence: Synthetic oligonucleotide
gaggactctagagtcctcc

SEQ ID NO: 15104 - DNA, 19 bp, Artificial Sequence
  Description of Artificial Sequence: Synthetic oligonucleotide
gaggactctagagtcctcg

SEQ ID NO: 15105 - DNA, 19 bp, Artificial Sequence
  Description of Artificial Sequence: Synthetic oligonucleotide
caggactctagagtcctga

SEQ ID NO: 15106 - DNA, 19 bp, Artificial Sequence
  Description of Artificial Sequence: Synthetic oligonucleotide
caggactctagagtcctgt

SEQ ID NO: 15107 - DNA, 19 bp, Artificial Sequence
  Description of Artificial Sequence: Synthetic oligonucleotide
caggactctagagtcctgc

SEQ ID NO: 15108 - DNA, 19 bp, Artificial Sequence
  Description of Artificial Sequence: Synthetic oligonucleotide
caggactctagagtcctgg

SEQ ID NO: 15109 - DNA, 19 bp, Artificial Sequence
  Description of Artificial Sequence: Synthetic oligonucleotide
gtggactctagagtccaca

SEQ ID NO: 15110 - DNA, 19 bp, Artificial Sequence
  Description of Artificial Sequence: Synthetic oligonucleotide
gtggactctagagtccact

SEQ ID NO: 15111 - DNA, 19 bp, Artificial Sequence
  Description of Artificial Sequence: Synthetic oligonucleotide
gtggactctagagtccacc

SEQ ID NO: 15112 - DNA, 19 bp, Artificial Sequence
  Description of Artificial Sequence: Synthetic oligonucleotide
gtggactctagagtccacg

SEQ ID NO: 15113 - DNA, 19 bp, Artificial Sequence
  Description of Artificial Sequence: Synthetic oligonucleotide
ctggactctagagtccaga

SEQ ID NO: 15114 - DNA, 19 bp, Artificial Sequence
  Description of Artificial Sequence: Synthetic oligonucleotide
ctggactctagagtccagt

SEQ ID NO: 15115 - DNA, 19 bp, Artificial Sequence
  Description of Artificial Sequence: Synthetic oligonucleotide
ctggactctagagtccagc

SEQ ID NO: 15116 - DNA, 19 bp, Artificial Sequence
  Description of Artificial Sequence: Synthetic oligonucleotide
ctggactctagagtccagg

SEQ ID NO: 15117 - DNA, 19 bp, Artificial Sequence
  Description of Artificial Sequence: Synthetic oligonucleotide
tgggactctagagtcccaa

SEQ ID NO: 15118 - DNA, 19 bp, Artificial Sequence
  Description of Artificial Sequence: Synthetic oligonucleotide
tgggactctagagtcccat

SEQ ID NO: 15119 - DNA, 19 bp, Artificial Sequence
  Description of Artificial Sequence: Synthetic oligonucleotide
tgggactctagagtcccac

SEQ ID NO: 15120 - DNA, 19 bp, Artificial Sequence
  Description of Artificial Sequence: Synthetic oligonucleotide
tgggactctagagtcccag

SEQ ID NO: 15121 - DNA, 19 bp, Artificial Sequence
  Description of Artificial Sequence: Synthetic oligonucleotide
agggactctagagtcccta

SEQ ID NO: 15122 - DNA, 19 bp, Artificial Sequence
  Description of Artificial Sequence: Synthetic oligonucleotide
agggactctagagtccctt

SEQ ID NO: 15123 - DNA, 19 bp, Artificial Sequence
  Description of Artificial Sequence: Synthetic oligonucleotide
agggactctagagtccctc

SEQ ID NO: 15124 - DNA, 19 bp, Artificial Sequence
  Description of Artificial Sequence: Synthetic oligonucleotide
agggactctagagtccctg

SEQ ID NO: 15125 - DNA, 19 bp, Artificial Sequence
  Description of Artificial Sequence: Synthetic oligonucleotide
ggggactctagagtcccca

SEQ ID NO: 15126 - DNA, 19 bp, Artificial Sequence
  Description of Artificial Sequence: Synthetic oligonucleotide
ggggactctagagtcccct

SEQ ID NO: 15127 - DNA, 19 bp, Artificial Sequence
  Description of Artificial Sequence: Synthetic oligonucleotide
ggggactctagagtccccg

SEQ ID NO: 15128 - DNA, 19 bp, Artificial Sequence
  Description of Artificial Sequence: Synthetic oligonucleotide
cgggactctagagtcccga

SEQ ID NO: 15129 - DNA, 19 bp, Artificial Sequence
  Description of Artificial Sequence: Synthetic oligonucleotide
cgggactctagagtcccgt

SEQ ID NO: 15130 - DNA, 19 bp, Artificial Sequence
  Description of Artificial Sequence: Synthetic oligonucleotide
cgggactctagagtcccgc

SEQ ID NO: 15131 - DNA, 17 bp, Artificial Sequence
  Description of Artificial Sequence: Synthetic oligonucleotide
cagactcgcgagtctga

SEQ ID NO: 15132 - DNA, 17 bp, Artificial Sequence
  Description of Artificial Sequence: Synthetic oligonucleotide
cagactcgcgagtctgt

SEQ ID NO: 15133 - DNA, 17 bp, Artificial Sequence
  Description of Artificial Sequence: Synthetic oligonucleotide
cagactcgcgagtctgc

SEQ ID NO: 15134 - DNA, 17 bp, Artificial Sequence
  Description of Artificial Sequence: Synthetic oligonucleotide
cagactcgcgagtctgg

SEQ ID NO: 15135 - DNA, 17 bp, Artificial Sequence
  Description of Artificial Sequence: Synthetic oligonucleotide
ctgactcgcgagtcaga

SEQ ID NO: 15136 - DNA, 17 bp, Artificial Sequence
  Description of Artificial Sequence: Synthetic oligonucleotide
ctgactcgcgagtcagt

SEQ ID NO: 15137 - DNA, 17 bp, Artificial Sequence
  Description of Artificial Sequence: Synthetic oligonucleotide
ctgactcgcgagtcagc

SEQ ID NO: 15138 - DNA, 17 bp, Artificial Sequence
  Description of Artificial Sequence: Synthetic oligonucleotide
ctgactcgcgagtcagg

SEQ ID NO: 15139 - DNA, 17 bp, Artificial Sequence
  Description of Artificial Sequence: Synthetic oligonucleotide
acgactcgcgagtcgta

SEQ ID NO: 15140 - DNA, 17 bp, Artificial Sequence
  Description of Artificial Sequence: Synthetic oligonucleotide
acgactcgcgagtcgtt

SEQ ID NO: 15141 - DNA, 17 bp, Artificial Sequence
  Description of Artificial Sequence: Synthetic oligonucleotide
acgactcgcgagtcgtc

SEQ ID NO: 15142 - DNA, 17 bp, Artificial Sequence
  Description of Artificial Sequence: Synthetic oligonucleotide
acgactcgcgagtcgtg

SEQ ID NO: 15143 - DNA, 17 bp, Artificial Sequence
  Description of Artificial Sequence: Synthetic oligonucleotide
ccgactcgcgagtcgga

SEQ ID NO: 15144 - DNA, 17 bp, Artificial Sequence
  Description of Artificial Sequence: Synthetic oligonucleotide
ccgactcgcgagtcggt

SEQ ID NO: 15145 - DNA, 17 bp, Artificial Sequence
  Description of Artificial Sequence: Synthetic oligonucleotide
ccgactcgcgagtcggc

SEQ ID NO: 15146 - DNA, 17 bp, Artificial Sequence
  Description of Artificial Sequence: Synthetic oligonucleotide
ccgactcgcgagtcggg

SEQ ID NO: 15147 - DNA, 17 bp, Artificial Sequence
  Description of Artificial Sequence: Synthetic oligonucleotide
gagactcgcgagtctca

SEQ ID NO: 15148 - DNA, 17 bp, Artificial Sequence
  Description of Artificial Sequence: Synthetic oligonucleotide
gagactcgcgagtctct

SEQ ID NO: 15149 - DNA, 17 bp, Artificial Sequence
  Description of Artificial Sequence: Synthetic oligonucleotide
gagactcgcgagtctcc

SEQ ID NO: 15150 - DNA, 17 bp, Artificial Sequence
  Description of Artificial Sequence: Synthetic oligonucleotide
gagactcgcgagtctcg

SEQ ID NO: 15151 - DNA, 17 bp, Artificial Sequence
  Description of Artificial Sequence: Synthetic oligonucleotide
gtgactcgcgagtcaca

SEQ ID NO: 15152 - DNA, 17 bp, Artificial Sequence
  Description of Artificial Sequence: Synthetic oligonucleotide
gtgactcgcgagtcact

SEQ ID NO: 15153 - DNA, 17 bp, Artificial Sequence
  Description of Artificial Sequence: Synthetic oligonucleotide
gtgactcgcgagtcacc

SEQ ID NO: 15154 - DNA, 17 bp, Artificial Sequence
  Description of Artificial Sequence: Synthetic oligonucleotide
gtgactcgcgagtcacg

SEQ ID NO: 15155 - DNA, 17 bp, Artificial Sequence
  Description of Artificial Sequence: Synthetic oligonucleotide
aggactcgcgagtccta

SEQ ID NO: 15156 - DNA, 17 bp, Artificial Sequence
  Description of Artificial Sequence: Synthetic oligonucleotide
aggactcgcgagtcctt

SEQ ID NO: 15157 - DNA, 17 bp, Artificial Sequence
  Description of Artificial Sequence: Synthetic oligonucleotide
aggactcgcgagtcctc

SEQ ID NO: 15158 - DNA, 17 bp, Artificial Sequence
  Description of Artificial Sequence: Synthetic oligonucleotide
aggactcgcgagtcctg

SEQ ID NO: 15159 - DNA, 17 bp, Artificial Sequence
  Description of Artificial Sequence: Synthetic oligonucleotide
tggactcgcgagtccaa

SEQ ID NO: 15160 - DNA, 17 bp, Artificial Sequence
  Description of Artificial Sequence: Synthetic oligonucleotide
tggactcgcgagtccat

SEQ ID NO: 15161 - DNA, 17 bp, Artificial Sequence
  Description of Artificial Sequence: Synthetic oligonucleotide
tggactcgcgagtccac

SEQ ID NO: 15162 - DNA, 17 bp, Artificial Sequence
  Description of Artificial Sequence: Synthetic oligonucleotide
tggactcgcgagtccag

SEQ ID NO: 15163 - DNA, 17 bp, Artificial Sequence
  Description of Artificial Sequence: Synthetic oligonucleotide
gggactcgcgagtccca

SEQ ID NO: 15164 - DNA, 17 bp, Artificial Sequence
  Description of Artificial Sequence: Synthetic oligonucleotide
gggactcgcgagtccct

SEQ ID NO: 15165 - DNA, 17 bp, Artificial Sequence
  Description of Artificial Sequence: Synthetic oligonucleotide
gggactcgcgagtcccc

SEQ ID NO: 15166 - DNA, 17 bp, Artificial Sequence
  Description of Artificial Sequence: Synthetic oligonucleotide
gggactcgcgagtcccg

SEQ ID NO: 15167 - DNA, 17 bp, Artificial Sequence
  Description of Artificial Sequence: Synthetic oligonucleotide
gcgactcgcgagtcgca

SEQ ID NO: 15168 - DNA, 17 bp, Artificial Sequence
  Description of Artificial Sequence: Synthetic oligonucleotide
gcgactcgcgagtcgct

SEQ ID NO: 15169 - DNA, 17 bp, Artificial Sequence
  Description of Artificial Sequence: Synthetic oligonucleotide
gcgactcgcgagtcgcc

SEQ ID NO: 15170 - DNA, 17 bp, Artificial Sequence
  Description of Artificial Sequence: Synthetic oligonucleotide
cggactcgcgagtccga

SEQ ID NO: 15171 - DNA, 17 bp, Artificial Sequence
  Description of Artificial Sequence: Synthetic oligonucleotide
cggactcgcgagtccgt

SEQ ID NO: 15172 - DNA, 17 bp, Artificial Sequence
  Description of Artificial Sequence: Synthetic oligonucleotide
cggactcgcgagtccgc

SEQ ID NO: 15173 - DNA, 17 bp, Artificial Sequence
  Description of Artificial Sequence: Synthetic oligonucleotide
acgactccggagtcgta

SEQ ID NO: 15174 - DNA, 17 bp, Artificial Sequence
  Description of Artificial Sequence: Synthetic oligonucleotide
acgactccggagtcgtt

SEQ ID NO: 15175 - DNA, 17 bp, Artificial Sequence
  Description of Artificial Sequence: Synthetic oligonucleotide
acgactccggagtcgtc

SEQ ID NO: 15176 - DNA, 17 bp, Artificial Sequence
  Description of Artificial Sequence: Synthetic oligonucleotide
acgactccggagtcgtg

SEQ ID NO: 15177 - DNA, 17 bp, Artificial Sequence
  Description of Artificial Sequence: Synthetic oligonucleotide
ccgactccggagtcgga

SEQ ID NO: 15178 - DNA, 17 bp, Artificial Sequence
  Description of Artificial Sequence: Synthetic oligonucleotide
ccgactccggagtcggt

SEQ ID NO: 15179 - DNA, 17 bp, Artificial Sequence
  Description of Artificial Sequence: Synthetic oligonucleotide
ccgactccggagtcggc

SEQ ID NO: 15180 - DNA, 17 bp, Artificial Sequence
  Description of Artificial Sequence: Synthetic oligonucleotide
ccgactccggagtcggg

SEQ ID NO: 15181 - DNA, 17 bp, Artificial Sequence
  Description of Artificial Sequence: Synthetic oligonucleotide
gtgactccggagtcaca

SEQ ID NO: 15182 - DNA, 17 bp, Artificial Sequence
  Description of Artificial Sequence: Synthetic oligonucleotide
gtgactccggagtcact

SEQ ID NO: 15183 - DNA, 17 bp, Artificial Sequence
  Description of Artificial Sequence: Synthetic oligonucleotide
gtgactccggagtcacc

SEQ ID NO: 15184 - DNA, 17 bp, Artificial Sequence
  Description of Artificial Sequence: Synthetic oligonucleotide
gtgactccggagtcacg

SEQ ID NO: 15185 - DNA, 17 bp, Artificial Sequence
  Description of Artificial Sequence: Synthetic oligonucleotide
aggactccggagtccta

SEQ ID NO: 15186 - DNA, 17 bp, Artificial Sequence
  Description of Artificial Sequence: Synthetic oligonucleotide
aggactccggagtcctt

SEQ ID NO: 15187 - DNA, 17 bp, Artificial Sequence
  Description of Artificial Sequence: Synthetic oligonucleotide
aggactccggagtcctc

SEQ ID NO: 15188 - DNA, 17 bp, Artificial Sequence
  Description of Artificial Sequence: Synthetic oligonucleotide
aggactccggagtcctg

SEQ ID NO: 15189 - DNA, 17 bp, Artificial Sequence
  Description of Artificial Sequence: Synthetic oligonucleotide
tggactccggagtccaa

SEQ ID NO: 15190 - DNA, 17 bp, Artificial Sequence
  Description of Artificial Sequence: Synthetic oligonucleotide
tggactccggagtccat

SEQ ID NO: 15191 - DNA, 17 bp, Artificial Sequence
  Description of Artificial Sequence: Synthetic oligonucleotide
tggactccggagtccac

SEQ ID NO: 15192 - DNA, 17 bp, Artificial Sequence
  Description of Artificial Sequence: Synthetic oligonucleotide
tggactccggagtccag

SEQ ID NO: 15193 - DNA, 17 bp, Artificial Sequence
  Description of Artificial Sequence: Synthetic oligonucleotide
gggactccggagtccca

SEQ ID NO: 15194 - DNA, 17 bp, Artificial Sequence
  Description of Artificial Sequence: Synthetic oligonucleotide
gggactccggagtccct

SEQ ID NO: 15195 - DNA, 17 bp, Artificial Sequence
  Description of Artificial Sequence: Synthetic oligonucleotide
gggactccggagtcccc

SEQ ID NO: 15196 - DNA, 17 bp, Artificial Sequence
  Description of Artificial Sequence: Synthetic oligonucleotide
gggactccggagtcccg

SEQ ID NO: 15197 - DNA, 17 bp, Artificial Sequence
  Description of Artificial Sequence: Synthetic oligonucleotide
gcgactccggagtcgca

SEQ ID NO: 15198 - DNA, 17 bp, Artificial Sequence
  Description of Artificial Sequence: Synthetic oligonucleotide
gcgactccggagtcgct

SEQ ID NO: 15199 - DNA, 17 bp, Artificial Sequence
  Description of Artificial Sequence: Synthetic oligonucleotide
gcgactccggagtcgcc

SEQ ID NO: 15200 - DNA, 17 bp, Artificial Sequence
  Description of Artificial Sequence: Synthetic oligonucleotide
cggactccggagtccga

SEQ ID NO: 15201 - DNA, 17 bp, Artificial Sequence
  Description of Artificial Sequence: Synthetic oligonucleotide
cggactccggagtccgt

SEQ ID NO: 15202 - DNA, 17 bp, Artificial Sequence
  Description of Artificial Sequence: Synthetic oligonucleotide
cggactccggagtccgc

SEQ ID NO: 15203 - DNA, 17 bp, Artificial Sequence
  Description of Artificial Sequence: Synthetic oligonucleotide
ccgactcatgagtcgga

SEQ ID NO: 15204 - DNA, 17 bp, Artificial Sequence
  Description of Artificial Sequence: Synthetic oligonucleotide
ccgactcatgagtcggt

SEQ ID NO: 15205 - DNA, 17 bp, Artificial Sequence
  Description of Artificial Sequence: Synthetic oligonucleotide
ccgactcatgagtcggc

SEQ ID NO: 15206 - DNA, 17 bp, Artificial Sequence
  Description of Artificial Sequence: Synthetic oligonucleotide
ccgactcatgagtcggg

SEQ ID NO: 15207 - DNA, 17 bp, Artificial Sequence
  Description of Artificial Sequence: Synthetic oligonucleotide
gcgactcatgagtcgca

SEQ ID NO: 15208 - DNA, 17 bp, Artificial Sequence
  Description of Artificial Sequence: Synthetic oligonucleotide
gcgactcatgagtcgct

SEQ ID NO: 15209 - DNA, 17 bp, Artificial Sequence
  Description of Artificial Sequence: Synthetic oligonucleotide
gcgactcatgagtcgcc

SEQ ID NO: 15210 - DNA, 17 bp, Artificial Sequence
  Description of Artificial Sequence: Synthetic oligonucleotide
cggactcatgagtccga

SEQ ID NO: 15211 - DNA, 17 bp, Artificial Sequence
  Description of Artificial Sequence: Synthetic oligonucleotide
cggactcatgagtccgt

SEQ ID NO: 15212 - DNA, 17 bp, Artificial Sequence
  Description of Artificial Sequence: Synthetic oligonucleotide
cggactcatgagtccgc

SEQ ID NO: 15213 - DNA, 17 bp, Artificial Sequence
  Description of Artificial Sequence: Synthetic oligonucleotide
gcgactctagagtcgca

SEQ ID NO: 15214 - DNA, 17 bp, Artificial Sequence
  Description of Artificial Sequence: Synthetic oligonucleotide
gcgactctagagtcgct

SEQ ID NO: 15215 - DNA, 17 bp, Artificial Sequence
  Description of Artificial Sequence: Synthetic oligonucleotide
gcgactctagagtcgcc

SEQ ID NO: 15216 - DNA, 16 bp, Artificial Sequence
  Description of Artificial Sequence: Synthetic oligonucleotide
gcgactcgcgagtcgc

SEQ ID NO: 15217 - DNA, 16 bp, Artificial Sequence
  Description of Artificial Sequence: Synthetic oligonucleotide
acgactcgcgagtcgt

SEQ ID NO: 15218 - DNA, 16 bp, Artificial Sequence
  Description of Artificial Sequence: Synthetic oligonucleotide
ccgactcgcgagtcgg

SEQ ID NO: 15219 - DNA, 16 bp, Artificial Sequence
  Description of Artificial Sequence: Synthetic oligonucleotide
cggactcgcgagtccg

SEQ ID NO: 15220 - DNA, 16 bp, Artificial Sequence
  Description of Artificial Sequence: Synthetic oligonucleotide
aggactcgcgagtcct

SEQ ID NO: 15221 - DNA, 16 bp, Artificial Sequence
  Description of Artificial Sequence: Synthetic oligonucleotide
tggactcgcgagtcca

SEQ ID NO: 15222 - DNA, 16 bp, Artificial Sequence
  Description of Artificial Sequence: Synthetic oligonucleotide
gggactcgcgagtccc

SEQ ID NO: 15223 - DNA, 16 bp, Artificial Sequence
  Description of Artificial Sequence: Synthetic oligonucleotide
cagactcgcgagtctg

SEQ ID NO: 15224 - DNA, 16 bp, Artificial Sequence
  Description of Artificial Sequence: Synthetic oligonucleotide
gagactcgcgagtctc

SEQ ID NO: 15225 - DNA, 16 bp, Artificial Sequence
  Description of Artificial Sequence: Synthetic oligonucleotide
ctgactcgcgagtcag

SEQ ID NO: 15226 - DNA, 16 bp, Artificial Sequence
  Description of Artificial Sequence: Synthetic oligonucleotide
gtgactcgcgagtcac

SEQ ID NO: 15227 - DNA, 16 bp, Artificial Sequence
  Description of Artificial Sequence: Synthetic oligonucleotide
gcgactccggagtcgc

SEQ ID NO: 15228 - DNA, 16 bp, Artificial Sequence
  Description of Artificial Sequence: Synthetic oligonucleotide
acgactccggagtcgt

SEQ ID NO: 15229 - DNA, 16 bp, Artificial Sequence
  Description of Artificial Sequence: Synthetic oligonucleotide
ccgactccggagtcgg

SEQ ID NO: 15230 - DNA, 16 bp, Artificial Sequence
  Description of Artificial Sequence: Synthetic oligonucleotide
cggactccggagtccg

SEQ ID NO: 15231 - DNA, 16 bp, Artificial Sequence
  Description of Artificial Sequence: Synthetic oligonucleotide
aggactccggagtcct

SEQ ID NO: 15232 - DNA, 16 bp, Artificial Sequence
  Description of Artificial Sequence: Synthetic oligonucleotide
tggactccggagtcca

SEQ ID NO: 15233 - DNA, 16 bp, Artificial Sequence
  Description of Artificial Sequence: Synthetic oligonucleotide
gggactccggagtccc

SEQ ID NO: 15234 - DNA, 16 bp, Artificial Sequence
  Description of Artificial Sequence: Synthetic oligonucleotide
gtgactccggagtcac

SEQ ID NO: 15235 - DNA, 16 bp, Artificial Sequence
  Description of Artificial Sequence: Synthetic oligonucleotide
gcgactcatgagtcgc

SEQ ID NO: 15236 - DNA, 16 bp, Artificial Sequence
  Description of Artificial Sequence: Synthetic oligonucleotide
ccgactcatgagtcgg

SEQ ID NO: 15237 - DNA, 16 bp, Artificial Sequence
  Description of Artificial Sequence: Synthetic oligonucleotide
cggactcatgagtccg

SEQ ID NO: 15238 - DNA, 16 bp, Artificial Sequence
  Description of Artificial Sequence: Synthetic oligonucleotide
gcgactctagagtcgc

SEQ ID NO: 15239 - DNA, 33 bp, Artificial Sequence
  Description of Artificial Sequence: Synthetic oligonucleotide
  Description of Combined DNA/RNA Molecule: Synthetic oligonucleotide
gactcgtgcacgagtcatactcatctgttuacc

SEQ ID NO: 15240 - DNA, 30 bp, Artificial Sequence
  Description of Artificial Sequence: Synthetic oligonucleotide
  Description of Combined DNA/RNA Molecule: Synthetic oligonucleotide
gactcgtgcacgagtcttttctctggaugg

SEQ ID NO: 15241 - DNA, 12 bp, Artificial Sequence
  Description of Artificial Sequence: Synthetic oligonucleotide
  modified_base (6)..(7): a, c, t, or g
gactcnngagtc

SEQ ID NO: 15242 - DNA, 13 bp, Artificial Sequence
  Description of Artificial Sequence: Synthetic oligonucleotide
  modified_base (6)..(7): a, c, t, or g
  modified_base (13)..(13): a, c, t, or g
gactcnngagtcn

SEQ ID NO: 15243 - DNA, 14 bp, Artificial Sequence
  Description of Artificial Sequence: Synthetic oligonucleotide
  modified_base (1)..(1): a, c, t, or g
  modified_base (7)..(8): a, c, t, or g
  modified_base (14)..(14): a, c, t, or g
ngactcnngagtcn

SEQ ID NO: 15244 - DNA, 15 bp, Artificial Sequence
  Description of Artificial Sequence: Synthetic oligonucleotide
  modified_base (1)..(1): a, c, t, or g
  modified_base (7)..(8): a, c, t, or g
  modified_base (14)..(15): a, c, t, or g
ngactcnngagtcnn

SEQ ID NO: 15245 - DNA, 16 bp, Artificial Sequence
  Description of Artificial Sequence: Synthetic oligonucleotide
  modified_base (1)..(2): a, c, t, or g
  modified_base (8)..(9): a, c, t, or g
  modified_base (15)..(16): a, c, t, or g
nngactcnngagtcnn

SEQ ID NO: 15246 - DNA, 17 bp, Artificial Sequence
  Description of Artificial Sequence: Synthetic oligonucleotide
  modified_base (1)..(2): a, c, t, or g
  modified_base (8)..(9): a, c, t, or g
  modified_base (15)..(17): a, c, t, or g
nngactcnngagtcnnn

SEQ ID NO: 15247 - DNA, 18 bp, Artificial Sequence
  Description of Artificial Sequence: Synthetic oligonucleotide
  modified_base (1)..(3): a, c, t, or g
  modified_base (9)..(10): a, c, t, or g
  modified_base (16)..(18): a, c, t, or g
nnngactcnngagtcnnn

SEQ ID NO: 15248 - DNA, 19 bp, Artificial Sequence
  Description of Artificial Sequence: Synthetic oligonucleotide
  modified_base (1)..(3): a, c, t, or g
  modified_base (9)..(10): a, c, t, or g
  modified_base (16)..(19): a, c, t, or g
nnngactcnngagtcnnnn

SEQ ID NO: 15249 - DNA, 20 bp, Artificial Sequence
  Description of Artificial Sequence: Synthetic oligonucleotide
  modified_base (1)..(4): a, c, t, or g
  modified_base (10)..(11): a, c, t, or g
  modified_base (17)..(20): a, c, t, or g
nnnngactcnngagtcnnnn

SEQ ID NO: 15250 - DNA, 14 bp, Artificial Sequence
  Description of Artificial Sequence: Synthetic oligonucleotide
  modified_base (6)..(9): a, c, t, or g
gactcnnnngagtc

SEQ ID NO: 15251 - DNA, 15 bp, Artificial Sequence
  Description of Artificial Sequence: Synthetic oligonucleotide
  modified_base (6)..(9): a, c, t, or g
  modified_base (15)..(15): a, c, t, or g
gactcnnnngagtcn

SEQ ID NO: 15252 - DNA, 16 bp, Artificial Sequence
  Description of Artificial Sequence: Synthetic oligonucleotide
  modified_base (1)..(1): a, c, t, or g
  modified_base (7)..(10): a, c, t, or g
  modified_base (16)..(16): a, c, t, or g
ngactcnnnngagtcn

SEQ ID NO: 15253 - DNA, 17 bp, Artificial Sequence
  Description of Artificial Sequence: Synthetic oligonucleotide
  modified_base (1)..(1): a, c, t, or g
  modified_base (7)..(10): a, c, t, or g
  modified_base (16)..(17): a, c, t, or g
ngactcnnnngagtcnn

SEQ ID NO: 15254 - DNA, 18 bp, Artificial Sequence
  Description of Artificial Sequence: Synthetic oligonucleotide
  modified_base (1)..(2): a, c, t, or g
  modified_base (8)..(11): a, c, t, or g
  modified_base (17)..(18): a, c, t, or g
nngactcnnnngagtcnn

SEQ ID NO: 15255 - DNA, 19 bp, Artificial Sequence
  Description of Artificial Sequence: Synthetic oligonucleotide
  modified_base (1)..(2): a, c, t, or g
  modified_base (8)..(11): a, c, t, or g
  modified_base (17)..(19): a, c, t, or g
nngactcnnnngagtcnnn

SEQ ID NO: 15256 - DNA, 20 bp, Artificial Sequence
  Description of Artificial Sequence: Synthetic oligonucleotide
  modified_base (1)..(3): a, c, t, or g
  modified_base (9)..(12): a, c, t, or g
  modified_base (18)..(20): a, c, t, or g
nnngactcnnnngagtcnnn

SEQ ID NO: 15257 - DNA, 21 bp, Artificial Sequence
  Description of Artificial Sequence: Synthetic oligonucleotide
  modified_base (1)..(3): a, c, t, or g
  modified_base (9)..(12): a, c, t, or g
  modified_base (18)..(21): a, c, t, or g
nnngactcnnnngagtcnnnn

SEQ ID NO: 15258 - DNA, 22 bp, Artificial Sequence
  Description of Artificial Sequence: Synthetic oligonucleotide
  modified_base (1)..(4): a, c, t, or g
  modified_base (10)..(13): a, c, t, or g
  modified_base (19)..(22): a, c, t, or g
nnnngactcnnnngagtcnnnn

SEQ ID NO: 15259 - DNA, 16 bp, Artificial Sequence
  Description of Artificial Sequence: Synthetic oligonucleotide
  modified_base (6)..(11): a, c, t, or g
gactcnnnnnngagtc

SEQ ID NO: 15260 - DNA, 17 bp, Artificial Sequence
  Description of Artificial Sequence: Synthetic oligonucleotide
  modified_base (6)..(11): a, c, t, or g
  modified_base (17)..(17): a, c, t, or g
gactcnnnnnngagtcn

SEQ ID NO: 15261 - DNA, 18 bp, Artificial Sequence
  Description of Artificial Sequence: Synthetic oligonucleotide
  modified_base (6)..(11): a, c, t, or g
  modified_base (17)..(18): a, c, t, or g
gactcnnnnnngagtcnn

SEQ ID NO: 15262 - DNA, 19 bp, Artificial Sequence
  Description of Artificial Sequence: Synthetic oligonucleotide
  modified_base (6)..(11): a, c, t, or g
  modified_base (17)..(19): a, c, t, or g
gactcnnnnnngagtcnnn

SEQ ID NO: 15263 - DNA, 20 bp, Artificial Sequence
  Description of Artificial Sequence: Synthetic oligonucleotide
  modified_base (6)..(11): a, c, t, or g
  modified_base (17)..(20): a, c, t, or g
gactcnnnnnngagtcnnnn

SEQ ID NO: 15264 - DNA, 18 bp, Artificial Sequence
  Description of Artificial Sequence: Synthetic oligonucleotide
  modified_base (1)..(1): a, c, t, or g
  modified_base (7)..(12): a, c, t, or g
  modified_base (18)..(18): a, c, t, or g
ngactcnnnnnngagtcn

SEQ ID NO: 15265 - DNA, 19 bp, Artificial Sequence
  Description of Artificial Sequence: Synthetic oligonucleotide
  modified_base (1)..(1): a, c, t, or g
  modified_base (7)..(12): a, c, t, or g
  modified_base (18)..(19): a, c, t, or g
ngactcnnnnnngagtcnn

SEQ ID NO: 15266 - DNA, 20 bp, Artificial Sequence
  Description of Artificial Sequence: Synthetic oligonucleotide
  modified_base (1)..(1): a, c, t, or g
  modified_base (7)..(12): a, c, t, or g
  modified_base (18)..(20): a, c, t, or g
ngactcnnnnnngagtcnnn

SEQ ID NO: 15267 - DNA, 21 bp, Artificial Sequence
  Description of Artificial Sequence: Synthetic oligonucleotide
  modified_base (1)..(1): a, c, t, or g
  modified_base (7)..(12): a, c, t, or g
  modified_base (18)..(21): a, c, t, or g
ngactcnnnnnngagtcnnnn

SEQ ID NO: 15268 - DNA, 20 bp, Artificial Sequence
  Description of Artificial Sequence: Synthetic oligonucleotide
  modified_base (1)..(2): a, c, t, or g
  modified_base (8)..(13): a, c, t, or g
  modified_base (19)..(20): a, c, t, or g
nngactcnnnnnngagtcnn

SEQ ID NO: 15269 - DNA, 21 bp, Artificial Sequence
  Description of Artificial Sequence: Synthetic oligonucleotide
  modified_base (1)..(2): a, c, t, or g
  modified_base (8)..(13): a, c, t, or g
  modified_base (19)..(21): a, c, t, or g
nngactcnnnnnngagtcnnn

SEQ ID NO: 15270 - DNA, 22 bp, Artificial Sequence
  Description of Artificial Sequence: Synthetic oligonucleotide
  modified_base (1)..(3): a, c, t, or g
  modified_base (9)..(14): a, c, t, or g
  modified_base (20)..(22): a, c, t, or g
nnngactcnnnnnngagtcnnn

SEQ ID NO: 15271 - DNA, 23 bp, Artificial Sequence
  Description of Artificial Sequence: Synthetic oligonucleotide
  modified_base (1)..(3): a, c, t, or g
  modified_base (9)..(14): a, c, t, or g
  modified_base (20)..(23): a, c, t, or g
nnngactcnnnnnngagtcnnnn

SEQ ID NO: 15272 - DNA, 24 bp, Artificial Sequence
  Description of Artificial Sequence: Synthetic oligonucleotide
  modified_base (1)..(4): a, c, t, or g
  modified_base (10)..(15): a, c, t, or g
  modified_base (21)..(24): a, c, t, or g
nnnngactcnnnnnngagtcnnnn

SEQ ID NO: 15273 - DNA, 16 bp, Artificial Sequence
  Description of Artificial Sequence: Synthetic oligonucleotide
  modified_base (8)..(9): a, c, t, or g
tcgactcnngagtcga

SEQ ID NO: 15274 - DNA, 17 bp, Artificial Sequence
  Description of Artificial Sequence: Synthetic oligonucleotide
  modified_base (8)..(9): a, c, t, or g
  modified_base (17)..(17): a, c, t, or g
tcgactcnngagtcgan

SEQ ID NO: 15275 - DNA, 18 bp, Artificial Sequence
  Description of Artificial Sequence: Synthetic oligonucleotide
  modified_base (1)..(1): a, c, t, or g
  modified_base (9)..(10): a, c, t, or g
  modified_base (18)..(18): a, c, t, or g
ntcgactcnngagtcgan

SEQ ID NO: 15276 - DNA, 19 bp, Artificial Sequence
  Description of Artificial Sequence: Synthetic oligonucleotide
  modified_base (1)..(1): a, c, t, or g
  modified_base (9)..(10): a, c, t, or g
  modified_base (18)..(19): a, c, t, or g
ntcgactcnngagtcgann

SEQ ID NO: 15277 - DNA, 18 bp, Artificial Sequence
  Description of Artificial Sequence: Synthetic oligonucleotide
  modified_base (9)..(10): a, c, t, or g
gtcgactcnngagtcgac

SEQ ID NO: 15278 - DNA, 19 bp, Artificial Sequence
  Description of Artificial Sequence: Synthetic oligonucleotide
  modified_base (9)..(10): a, c, t, or g
  modified_base (19)..(19): a, c, t, or g
gtcgactcnngagtcgacn

SEQ ID NO: 15279 - DNA, 20 bp, Artificial Sequence
  Description of Artificial Sequence: Synthetic oligonucleotide
  modified_base (1)..(2): a, c, t, or g
  modified_base (10)..(11): a, c, t, or g
  modified_base (19)..(20): a, c, t, or g
nntcgactcnngagtcgann

SEQ ID NO: 15280 - DNA, 20 bp, Artificial Sequence
  Description of Artificial Sequence: Synthetic oligonucleotide
  modified_base (1)..(1): a, c, t, or g
  modified_base (10)..(11): a, c, t, or g
  modified_base (20)..(20): a, c, t, or g
ngtcgactcnngagtcgacn

SEQ ID NO: 15281 - DNA, 20 bp, Artificial Sequence
  Description of Artificial Sequence: Synthetic oligonucleotide
  modified_base (10)..(11): a, c, t, or g
agtcgactcnngagtcgact

SEQ ID NO: 15282 - DNA, 14 bp, Artificial Sequence
  Description of Artificial Sequence: Synthetic oligonucleotide
gactcgatcgagtc

SEQ ID NO: 15283 - DNA, 15 bp, Artificial Sequence
  Description of Artificial Sequence: Synthetic oligonucleotide
  modified_base (15)..(15): a, c, t, or g
gactcgatcgagtcn

SEQ ID NO: 15284 - DNA, 16 bp, Artificial Sequence
  Description of Artificial Sequence: Synthetic oligonucleotide
  modified_base (1)..(1): a, c, t, or g
  modified_base (16)..(16): a, c, t, or g
ngactcgatcgagtcn

SEQ ID NO: 15285 - DNA, 17 bp, Artificial Sequence
  Description of Artificial Sequence: Synthetic oligonucleotide
  modified_base (1)..(1): a, c, t, or g
  modified_base (16)..(17): a, c, t, or g
ngactcgatcgagtcnn

SEQ ID NO: 15286 - DNA, 18 bp, Artificial Sequence
  Description of Artificial Sequence: Synthetic oligonucleotide
  modified_base (1)..(2): a, c, t, or g
  modified_base (17)..(18): a, c, t, or g
nngactcgatcgagtcnn

SEQ ID NO: 15287 - DNA, 19 bp, Artificial Sequence
  Description of Artificial Sequence: Synthetic oligonucleotide
  modified_base (1)..(2): a, c, t, or g
  modified_base (17)..(19): a, c, t, or g
nngactcgatcgagtcnnn

SEQ ID NO: 15288 - DNA, 18 bp, Artificial Sequence
  Description of Artificial Sequence: Synthetic oligonucleotide
  modified_base (8)..(11): a, c, t, or g
tcgactcnnnngagtcga

SEQ ID NO: 15289 - DNA, 19 bp, Artificial Sequence
  Description of Artificial Sequence: Synthetic oligonucleotide
  modified_base (8)..(11): a, c, t, or g
  modified_base (19)..(19): a, c, t, or g
tcgactcnnnngagtcgan

SEQ ID NO: 15290 - DNA, 20 bp, Artificial Sequence
  Description of Artificial Sequence: Synthetic oligonucleotide
  modified_base (1)..(3): a, c, t, or g
  modified_base (18)..(20): a, c, t, or g
nnngactcgatcgagtcnnn

SEQ ID NO: 15291 - DNA, 21 bp, Artificial Sequence
  Description of Artificial Sequence: Synthetic oligonucleotide
  modified_base (1)..(3): a, c, t, or g
  modified_base (18)..(21): a, c, t, or g
nnngactcgatcgagtcnnnn

SEQ ID NO: 15292 - DNA, 20 bp, Artificial Sequence
  Description of Artificial Sequence: Synthetic oligonucleotide
  modified_base (1)..(1): a, c, t, or g
  modified_base (9)..(12): a, c, t, or g
  modified_base (20)..(20): a, c, t, or g
ntcgactcnnnngagtcgan

SEQ ID NO: 15293 - DNA, 21 bp, Artificial Sequence
  Description of Artificial Sequence: Synthetic oligonucleotide
  modified_base (1)..(1): a, c, t, or g
  modified_base (9)..(12): a, c, t, or g
  modified_base (20)..(21): a, c, t, or g
ntcgactcnnnngagtcgann

SEQ ID NO: 15294 - DNA, 20 bp, Artificial Sequence
  Description of Artificial Sequence: Synthetic oligonucleotide
  modified_base (9)..(12): a, c, t, or g
gtcgactcnnnngagtcgac

SEQ ID NO: 15295 - DNA, 21 bp, Artificial Sequence
  Description of Artificial Sequence: Synthetic oligonucleotide
  modified_base (9)..(12): a, c, t, or g
  modified_base (21)..(21): a, c, t, or g
gtcgactcnnnngagtcgacn

SEQ ID NO: 15296 - DNA, 22 bp, Artificial Sequence
  Description of Artificial Sequence: Synthetic oligonucleotide
  modified_base (1)..(4): a, c, t, or g
  modified_base (19)..(22): a, c, t, or g
nnnngactcgatcgagtcnnnn

SEQ ID NO: 15297 - DNA, 22 bp, Artificial Sequence
  Description of Artificial Sequence: Synthetic oligonucleotide
  modified_base (1)..(2): a, c, t, or g
  modified_base (10)..(13): a, c, t, or g
  modified_base (21)..(22): a, c, t, or g
nntcgactcnnnngagtcgann

SEQ ID NO: 15298 - DNA, 22 bp, Artificial Sequence
  Description of Artificial Sequence: Synthetic oligonucleotide
  modified_base (1)..(1): a, c, t, or g
  modified_base (10)..(13): a, c, t, or g
  modified_base (22)..(22): a, c, t, or g
ngtcgactcnnnngagtcgacn

SEQ ID NO: 15299 - DNA, 22 bp, Artificial Sequence
  Description of Artificial Sequence: Synthetic oligonucleotide
  modified_base (10)..(13): a, c, t, or g
agtcgactcnnnngagtcgact

SEQ ID NO: 15300 - DNA, 16 bp, Artificial Sequence
  Description of Artificial Sequence: Synthetic oligonucleotide
  modified_base (8)..(9): a, c, t, or g
gactcganntcgagtc

SEQ ID NO: 15301 - DNA, 17 bp, Artificial Sequence
  Description of Artificial Sequence: Synthetic oligonucleotide
  modified_base (8)..(9): a, c, t, or g
  modified_base (17)..(17): a, c, t, or g
gactcganntcgagtcn

SEQ ID NO: 15302 - DNA, 18 bp, Artificial Sequence
  Description of Artificial Sequence: Synthetic oligonucleotide
  modified_base (1)..(1): a, c, t, or g
  modified_base (9)..(10): a, c, t, or g
  modified_base (18)..(18): a, c, t, or g
ngactcganntcgagtcn

SEQ ID NO: 15303 - DNA, 19 bp, Artificial Sequence
  Description of Artificial Sequence: Synthetic oligonucleotide
  modified_base (1)..(1): a, c, t, or g
  modified_base (9)..(10): a, c, t, or g
  modified_base (18)..(19): a, c, t, or g
ngactcganntcgagtcnn

SEQ ID NO: 15304 - DNA, 20 bp, Artificial Sequence
  Description of Artificial Sequence: Synthetic oligonucleotide
  modified_base (1)..(2): a, c, t, or g
  modified_base (10)..(11): a, c, t, or g
  modified_base (19)..(20): a, c, t, or g
nngactcganntcgagtcnn

SEQ ID NO: 15305 - DNA, 21 bp, Artificial Sequence
  Description of Artificial Sequence: Synthetic oligonucleotide
  modified_base (1)..(2): a, c, t, or g
  modified_base (10)..(11): a, c, t, or g
  modified_base (19)..(21): a, c, t, or g
nngactcganntcgagtcnnn

SEQ ID NO: 15306 - DNA, 20 bp, Artificial Sequence
  Description of Artificial Sequence: Synthetic oligonucleotide
  modified_base (8)..(13): a, c, t, or g
tcgactcnnnnnngagtcga

SEQ ID NO: 15307 - DNA, 21 bp, Artificial Sequence
  Description of Artificial Sequence: Synthetic oligonucleotide
  modified_base (8)..(13): a, c, t, or g
  modified_base (21)..(21): a, c, t, or g
tcgactcnnnnnngagtcgan

SEQ ID NO: 15308 - DNA, 22 bp, Artificial Sequence
  Description of Artificial Sequence: Synthetic oligonucleotide
  modified_base (1)..(3): a, c, t, or g
  modified_base (11)..(12): a, c, t, or g
  modified_base (20)..(22): a, c, t, or g
nnngactcganntcgagtcnnn

SEQ ID NO: 15309 - DNA, 23 bp, Artificial Sequence
  Description of Artificial Sequence: Synthetic oligonucleotide
  modified_base (1)..(3): a, c, t, or g
  modified_base (11)..(12): a, c, t, or g
  modified_base (20)..(23): a, c, t, or g
nnngactcganntcgagtcnnnn

SEQ ID NO: 15310 - DNA, 24 bp, Artificial Sequence
  Description of Artificial Sequence: Synthetic oligonucleotide
  modified_base (1)..(1): a, c, t, or g
  modified_base (10)..(15): a, c, t, or g
  modified_base (24)..(24): a, c, t, or g
ngtcgactcnnnnnngagtcgacn

SEQ ID NO: 15311 - DNA, 22 bp, Artificial Sequence
  Description of Artificial Sequence: Synthetic oligonucleotide
  modified_base (9)..(14): a, c, t, or g
gtcgactcnnnnnngagtcgac

SEQ ID NO: 15312 - DNA, 23 bp, Artificial Sequence
  Description of Artificial Sequence: Synthetic oligonucleotide
  modified_base (9)..(14): a, c, t, or g
  modified_base (23)..(23): a, c, t, or g
gtcgactcnnnnnngagtcgacn

SEQ ID NO: 15313 - DNA, 24 bp, Artificial Sequence
  Description of Artificial Sequence: Synthetic oligonucleotide
  modified_base (1)..(4): a, c, t, or g
  modified_base (12)..(13): a, c, t, or g
  modified_base (21)..(24): a, c, t, or g
nnnngactcganntcgagtcnnnn

SEQ ID NO: 15314 - DNA, 24 bp, Artificial Sequence
  Description of Artificial Sequence: Synthetic oligonucleotide
  modified_base (1)..(2): a, c, t, or g
  modified_base (10)..(15): a, c, t, or g
  modified_base (23)..(24): a, c, t, or g
nntcgactcnnnnnngagtcgann

SEQ ID NO: 15315 - DNA, 24 bp, Artificial Sequence
  Description of Artificial Sequence: Synthetic oligonucleotide
  modified_base (10)..(15): a, c, t, or g
agtcgactcnnnnnngagtcgact

SEQ ID NO: 15316 - DNA, 72 bp, Glycine max
ccaaggttctcattacctatgatgcctccaccagcctcttggttgcttctttggtctacccttcacagagaa

SEQ ID NO: 15317 - DNA, 15 bp, Artificial Sequence
  Description of Artificial Sequence: Synthetic primer
attacctatgatgcc

SEQ ID NO: 15318 - DNA, 14 bp, Artificial Sequence
  Description of Artificial Sequence: Synthetic primer
accaaagaagcaac

SEQ ID NO: 15319 - DNA, 39 bp, Artificial Sequence
  Description of Artificial Sequence: Synthetic oligonucleotide
  Description of Combined DNA/RNA Molecule: Synthetic oligonucleotide
acgcgactcgtcgacgagtcgcgtattacctatgaugcc

SEQ ID NO: 15320 - DNA, 38 bp, Artificial Sequence
  Description of Artificial Sequence: Synthetic oligonucleotide
  Description of Combined DNA/RNA Molecule: Synthetic oligonucleotide
acgcgactcgtcgacgagtcgcgtaccaaagaagcaac

SEQ ID NO: 15321 - DNA, 24 bp, Artificial Sequence
  Description of Artificial Sequence: Synthetic probe
  modified_base (13)..(13): Inosine
cgcgctccaccancctcttgcgcg

SEQ ID NO: 15322 - DNA, 38 bp, Salmonella enterica
atactcatctgtttaccgggcataccatccagagaaaa

SEQ ID NO: 15323 - DNA, 17 bp, Artificial Sequence
  Description of Artificial Sequence: Synthetic primer
atactcatctgtttacc

SEQ ID NO: 15324 - DNA, 14 bp, Artificial Sequence
  Description of Artificial Sequence: Synthetic primer
ttttctctggatgg

SEQ ID NO: 15325 - DNA, 41 bp, Artificial Sequence
  Description of Artificial Sequence: Synthetic oligonucleotide
  Description of Combined DNA/RNA Molecule: Synthetic oligonucleotide
ggctgactcctgcaggagtcagccatactcatctguuuacc

SEQ ID NO: 15326 - DNA, 41 bp, Artificial Sequence
  Description of Artificial Sequence: Synthetic oligonucleotide
  Description of Combined DNA/RNA Molecule: Synthetic oligonucleotide
ggctgactcctgcaggagtcagccatactcatctgtuuacc

SEQ ID NO: 15327 - DNA, 38 bp, Artificial Sequence
  Description of Artificial Sequence: Synthetic oligonucleotide
  Description of Combined DNA/RNA Molecule: Synthetic oligonucleotide
ggctgactcctgcaggagtcagccttttctctggaugg

SEQ ID NO: 15328 - DNA, 27 bp, Artificial Sequence
  Description of Artificial Sequence: Synthetic probe
acctgtttaccgggcatacaaacaggt

SEQ ID NO: 15329 - DNA, 24 bp, Artificial Sequence
  Description of Artificial Sequence: Synthetic oligonucleotide
ccgggactccgcgcggagtcccgg

SEQ ID NO: 15330 - DNA, 24 bp, Artificial Sequence
  Description of Artificial Sequence: Synthetic oligonucleotide
cccggactccgcgcggagtccggg

SEQ ID NO: 15331 - DNA, 24 bp, Artificial Sequence
  Description of Artificial Sequence: Synthetic oligonucleotide
gccggactccgcgcggagtccggc

SEQ ID NO: 15332 - DNA, 24 bp, Artificial Sequence
  Description of Artificial Sequence: Synthetic oligonucleotide
ggccgactccgcgcggagtcggcc

SEQ ID NO: 15333 - DNA, 24 bp, Artificial Sequence
  Description of Artificial Sequence: Synthetic oligonucleotide
ggtcgactccgcgcggagtcgacc

SEQ ID NO: 15334 - DNA, 24 bp, Artificial Sequence
  Description of Artificial Sequence: Synthetic oligonucleotide
gctcgactccgcgcggagtcgagc

SEQ ID NO: 15335 - DNA, 24 bp, Artificial Sequence
  Description of Artificial Sequence: Synthetic oligonucleotide
accggactccgcgcggagtccggt

SEQ ID NO: 15336 - DNA, 24 bp, Artificial Sequence
  Description of Artificial Sequence: Synthetic oligonucleotide
tccggactccgcgcggagtccgga

SEQ ID NO: 15337 - DNA, 24 bp, Artificial Sequence
  Description of Artificial Sequence: Synthetic oligonucleotide
ggcggactcgggcccgagtccgcc

SEQ ID NO: 15338 - DNA, 24 bp, Artificial Sequence
  Description of Artificial Sequence: Synthetic oligonucleotide
gcccgactcgggcccgagtcgggc

SEQ ID NO: 15339 - DNA, 24 bp, Artificial Sequence
  Description of Artificial Sequence: Synthetic oligonucleotide
gggcgactcgggcccgagtcgccc

SEQ ID NO: 15340 - DNA, 24 bp, Artificial Sequence
  Description of Artificial Sequence: Synthetic oligonucleotide
gggagactcgggcccgagtctccc

SEQ ID NO: 15341 - DNA, 24 bp, Artificial Sequence
  Description of Artificial Sequence: Synthetic oligonucleotide
gggtgactcgggcccgagtcaccc

SEQ ID NO: 15342 - DNA, 24 bp, Artificial Sequence
  Description of Artificial Sequence: Synthetic oligonucleotide
ggacgactcgggcccgagtcgtcc

SEQ ID NO: 15343 - DNA, 24 bp, Artificial Sequence
  Description of Artificial Sequence: Synthetic oligonucleotide
gcacgactcgggcccgagtcgtgc

SEQ ID NO: 15344 - DNA, 24 bp, Artificial Sequence
  Description of Artificial Sequence: Synthetic oligonucleotide
gaccgactcgggcccgagtcggtc

SEQ ID NO: 15345 - DNA, 24 bp, Artificial Sequence
  Description of Artificial Sequence: Synthetic oligonucleotide
gtccgactcgggcccgagtcggac

SEQ ID NO: 15346 - DNA, 24 bp, Artificial Sequence
  Description of Artificial Sequence: Synthetic oligonucleotide
acccgactcgggcccgagtcgggt

SEQ ID NO: 15347 - DNA, 24 bp, Artificial Sequence
  Description of Artificial Sequence: Synthetic oligonucleotide
tcccgactcgggcccgagtcggga

SEQ ID NO: 15348 - DNA, 24 bp, Artificial Sequence
  Description of Artificial Sequence: Synthetic oligonucleotide
gccagactcgggcccgagtctggc

SEQ ID NO: 15349 - DNA, 24 bp, Artificial Sequence
  Description of Artificial Sequence: Synthetic oligonucleotide
gcctgactcgggcccgagtcaggc

SEQ ID NO: 15350 - DNA, 24 bp, Artificial Sequence
  Description of Artificial Sequence: Synthetic oligonucleotide
gacggactcgggcccgagtccgtc

SEQ ID NO: 15351 - DNA, 24 bp, Artificial Sequence
  Description of Artificial Sequence: Synthetic oligonucleotide
gtcggactcgggcccgagtccgac

SEQ ID NO: 15352 - DNA, 24 bp, Artificial Sequence
  Description of Artificial Sequence: Synthetic oligonucleotide
agcggactcgggcccgagtccgct

SEQ ID NO: 15353 - DNA, 24 bp, Artificial Sequence
  Description of Artificial Sequence: Synthetic oligonucleotide
tgcggactcgggcccgagtccgca

SEQ ID NO: 15354 - DNA, 24 bp, Artificial Sequence
  Description of Artificial Sequence: Synthetic oligonucleotide
ggaggactcgggcccgagtcctcc

SEQ ID NO: 15355 - DNA, 24 bp, Artificial Sequence
  Description of Artificial Sequence: Synthetic oligonucleotide
ggtggactcgggcccgagtccacc

SEQ ID NO: 15356 - DNA, 24 bp, Artificial Sequence
  Description of Artificial Sequence: Synthetic oligonucleotide
ggcagactcgggcccgagtctgcc

SEQ ID NO: 15357 - DNA, 24 bp, Artificial Sequence
  Description of Artificial Sequence: Synthetic oligonucleotide
ggctgactcgggcccgagtcagcc

SEQ ID NO: 15358 - DNA, 24 bp, Artificial Sequence
  Description of Artificial Sequence: Synthetic oligonucleotide
cacggactcgggcccgagtccgtg

SEQ ID NO: 15359 - DNA, 24 bp, Artificial Sequence
  Description of Artificial Sequence: Synthetic oligonucleotide
ctcggactcgggcccgagtccgag

SEQ ID NO: 15360 - DNA, 24 bp, Artificial Sequence
  Description of Artificial Sequence: Synthetic oligonucleotide
ccaggactcgggcccgagtcctgg

SEQ ID NO: 15361 - DNA, 24 bp, Artificial Sequence
  Description of Artificial Sequence: Synthetic oligonucleotide
cctggactcgggcccgagtccagg

SEQ ID NO: 15362 - DNA, 24 bp, Artificial Sequence
  Description of Artificial Sequence: Synthetic oligonucleotide
cccagactcgggcccgagtctggg

SEQ ID NO: 15363 - DNA, 24 bp, Artificial Sequence
  Description of Artificial Sequence: Synthetic oligonucleotide
ccctgactcgggcccgagtcaggg

SEQ ID NO: 15364 - DNA, 24 bp, Artificial Sequence
  Description of Artificial Sequence: Synthetic oligonucleotide
acgggactcgggcccgagtcccgt

SEQ ID NO: 15365 - DNA, 24 bp, Artificial Sequence
  Description of Artificial Sequence: Synthetic oligonucleotide
tcgggactcgggcccgagtcccga

SEQ ID NO: 15366 - DNA, 24 bp, Artificial Sequence
  Description of Artificial Sequence: Synthetic oligonucleotide
cagggactcgggcccgagtccctg

SEQ ID NO: 15367 - DNA, 24 bp, Artificial Sequence
  Description of Artificial Sequence: Synthetic oligonucleotide
ctgggactcgggcccgagtcccag

SEQ ID NO: 15368 - DNA, 24 bp, Artificial Sequence
  Description of Artificial Sequence: Synthetic oligonucleotide
ggcggactcggcgccgagtccgcc

SEQ ID NO: 15369 - DNA, 24 bp, Artificial Sequence
  Description of Artificial Sequence: Synthetic oligonucleotide
gcccgactcggcgccgagtcgggc

SEQ ID NO: 15370 - DNA, 24 bp, Artificial Sequence
  Description of Artificial Sequence: Synthetic oligonucleotide
gggcgactcggcgccgagtcgccc

SEQ ID NO: 15371 - DNA, 24 bp, Artificial Sequence
  Description of Artificial Sequence: Synthetic oligonucleotide
gggagactcggcgccgagtctccc

SEQ ID NO: 15372 - DNA, 24 bp, Artificial Sequence
  Description of Artificial Sequence: Synthetic oligonucleotide
gggtgactcggcgccgagtcaccc

SEQ ID NO: 15373 - DNA, 24 bp, Artificial Sequence
  Description of Artificial Sequence: Synthetic oligonucleotide
ggacgactcggcgccgagtcgtcc

SEQ ID NO: 15374 - DNA, 24 bp, Artificial Sequence
  Description of Artificial Sequence: Synthetic oligonucleotide
gcacgactcggcgccgagtcgtgc

SEQ ID NO: 15375 - DNA, 24 bp, Artificial Sequence
  Description of Artificial Sequence: Synthetic oligonucleotide
gaccgactcggcgccgagtcggtc

SEQ ID NO: 15376 - DNA, 24 bp, Artificial Sequence
  Description of Artificial Sequence: Synthetic oligonucleotide
gtccgactcggcgccgagtcggac

SEQ ID NO: 15377 - DNA, 24 bp, Artificial Sequence
  Description of Artificial Sequence: Synthetic oligonucleotide
acccgactcggcgccgagtcgggt

SEQ ID NO: 15378 - DNA, 24 bp, Artificial Sequence
  Description of Artificial Sequence: Synthetic oligonucleotide
tcccgactcggcgccgagtcggga

SEQ ID NO: 15379 - DNA, 24 bp, Artificial Sequence
  Description of Artificial Sequence: Synthetic oligonucleotide
gccagactcggcgccgagtctggc

SEQ ID NO: 15380 - DNA, 24 bp, Artificial Sequence
  Description of Artificial Sequence: Synthetic oligonucleotide
gcctgactcggcgccgagtcaggc

SEQ ID NO: 15381 - DNA, 24 bp, Artificial Sequence
  Description of Artificial Sequence: Synthetic oligonucleotide
gacggactcggcgccgagtccgtc

SEQ ID NO: 15382 - DNA, 24 bp, Artificial Sequence
  Description of Artificial Sequence: Synthetic oligonucleotide
gtcggactcggcgccgagtccgac

SEQ ID NO: 15383 - DNA, 24 bp, Artificial Sequence
  Description of Artificial Sequence: Synthetic oligonucleotide
agcggactcggcgccgagtccgct

SEQ ID NO: 15384 - DNA, 24 bp, Artificial Sequence
  Description of Artificial Sequence: Synthetic oligonucleotide
tgcggactcggcgccgagtccgca

SEQ ID NO: 15385 - DNA, 24 bp, Artificial Sequence
  Description of Artificial Sequence: Synthetic oligonucleotide
ggaggactcggcgccgagtcctcc

SEQ ID NO: 15386 - DNA, 24 bp, Artificial Sequence
  Description of Artificial Sequence: Synthetic oligonucleotide
ggtggactcggcgccgagtccacc

SEQ ID NO: 15387 - DNA, 24 bp, Artificial Sequence
  Description of Artificial Sequence: Synthetic oligonucleotide
ggcagactcggcgccgagtctgcc

SEQ ID NO: 15388 - DNA, 24 bp, Artificial Sequence
  Description of Artificial Sequence: Synthetic oligonucleotide
ggctgactcggcgccgagtcagcc

SEQ ID NO: 15389 - DNA, 24 bp, Artificial Sequence
  Description of Artificial Sequence: Synthetic oligonucleotide
cacggactcggcgccgagtccgtg

SEQ ID NO: 15390 - DNA, 24 bp, Artificial Sequence
  Description of Artificial Sequence: Synthetic oligonucleotide
ctcggactcggcgccgagtccgag

SEQ ID NO: 15391 - DNA, 24 bp, Artificial Sequence
  Description of Artificial Sequence: Synthetic oligonucleotide
ccaggactcggcgccgagtcctgg

SEQ ID NO: 15392 - DNA, 24 bp, Artificial Sequence
  Description of Artificial Sequence: Synthetic oligonucleotide
cctggactcggcgccgagtccagg

SEQ ID NO: 15393 - DNA, 24 bp, Artificial Sequence
  Description of Artificial Sequence: Synthetic oligonucleotide
cccagactcggcgccgagtctggg

SEQ ID NO: 15394 - DNA, 24 bp, Artificial Sequence
  Description of Artificial Sequence: Synthetic oligonucleotide
ccctgactcggcgccgagtcaggg

SEQ ID NO: 15395 - DNA, 24 bp, Artificial Sequence
  Description of Artificial Sequence: Synthetic oligonucleotide
acgggactcggcgccgagtcccgt

SEQ ID NO: 15396 - DNA, 24 bp, Artificial Sequence
  Description of Artificial Sequence: Synthetic oligonucleotide
tcgggactcggcgccgagtcccga

SEQ ID NO: 15397 - DNA, 24 bp, Artificial Sequence
  Description of Artificial Sequence: Synthetic oligonucleotide
cagggactcggcgccgagtccctg

SEQ ID NO: 15398 - DNA, 24 bp, Artificial Sequence
  Description of Artificial Sequence: Synthetic oligonucleotide
ctgggactcggcgccgagtcccag

SEQ ID NO: 15399 - DNA, 24 bp, Artificial Sequence
  Description of Artificial Sequence: Synthetic oligonucleotide
ccgggactctgcgcagagtcccgg

SEQ ID NO: 15400 - DNA, 24 bp, Artificial Sequence
  Description of Artificial Sequence: Synthetic oligonucleotide
cccggactctgcgcagagtccggg

SEQ ID NO: 15401 - DNA, 24 bp, Artificial Sequence
  Description of Artificial Sequence: Synthetic oligonucleotide
gccggactctgcgcagagtccggc

SEQ ID NO: 15402 - DNA, 24 bp, Artificial Sequence
  Description of Artificial Sequence: Synthetic oligonucleotide
ggccgactctgcgcagagtcggcc

SEQ ID NO: 15403 - DNA, 24 bp, Artificial Sequence
  Description of Artificial Sequence: Synthetic oligonucleotide
ggtcgactctgcgcagagtcgacc

SEQ ID NO: 15404 - DNA, 24 bp, Artificial Sequence
  Description of Artificial Sequence: Synthetic oligonucleotide
gctcgactctgcgcagagtcgagc

SEQ ID NO: 15405 - DNA, 24 bp, Artificial Sequence
  Description of Artificial Sequence: Synthetic oligonucleotide
accggactctgcgcagagtccggt

SEQ ID NO: 15406 - DNA, 24 bp, Artificial Sequence
  Description of Artificial Sequence: Synthetic oligonucleotide
tccggactctgcgcagagtccgga

SEQ ID NO: 15407 - DNA, 24 bp, Artificial Sequence
  Description of Artificial Sequence: Synthetic oligonucleotide
ccgggactcagcgctgagtcccgg

SEQ ID NO: 15408 - DNA, 24 bp, Artificial Sequence
  Description of Artificial Sequence: Synthetic oligonucleotide
cccggactcagcgctgagtccggg

SEQ ID NO: 15409 - DNA, 24 bp, Artificial Sequence
  Description of Artificial Sequence: Synthetic oligonucleotide
gccggactcagcgctgagtccggc

SEQ ID NO: 15410 - DNA, 24 bp, Artificial Sequence
  Description of Artificial Sequence: Synthetic oligonucleotide
ggccgactcagcgctgagtcggcc

SEQ ID NO: 15411 - DNA, 24 bp, Artificial Sequence
  Description of Artificial Sequence: Synthetic oligonucleotide
ggtcgactcagcgctgagtcgacc

SEQ ID NO: 15412 - DNA, 24 bp, Artificial Sequence
  Description of Artificial Sequence: Synthetic oligonucleotide
gctcgactcagcgctgagtcgagc

SEQ ID NO: 15413 - DNA, 24 bp, Artificial Sequence
  Description of Artificial Sequence: Synthetic oligonucleotide
accggactcagcgctgagtccggt

SEQ ID NO: 15414 - DNA, 24 bp, Artificial Sequence
  Description of Artificial Sequence: Synthetic oligonucleotide
tccggactcagcgctgagtccgga

SEQ ID NO: 15415 - DNA, 23 bp, Artificial Sequence
  Description of Artificial Sequence: Synthetic oligonucleotide
cctggactaccggtgagtccagg

SEQ ID NO: 15416 - DNA, 24 bp, Artificial Sequence
  Description of Artificial Sequence: Synthetic oligonucleotide
ccgggactcctcgaggagtcccgg

SEQ ID NO: 15417 - DNA, 24 bp, Artificial Sequence
  Description of Artificial Sequence: Synthetic oligonucleotide
cccggactcctcgaggagtccggg

SEQ ID NO: 15418 - DNA, 24 bp, Artificial Sequence
  Description of Artificial Sequence: Synthetic oligonucleotide
gccggactcctcgaggagtccggc

SEQ ID NO: 15419 - DNA, 24 bp, Artificial Sequence
  Description of Artificial Sequence: Synthetic oligonucleotide
ggccgactcctcgaggagtcggcc

SEQ ID NO: 15420 - DNA, 24 bp, Artificial Sequence
  Description of Artificial Sequence: Synthetic oligonucleotide
ggtcgactcctcgaggagtcgacc

SEQ ID NO: 15421 - DNA, 24 bp, Artificial Sequence
  Description of Artificial Sequence: Synthetic oligonucleotide
gctcgactcctcgaggagtcgagc

SEQ ID NO: 15422 - DNA, 24 bp, Artificial Sequence
  Description of Artificial Sequence: Synthetic oligonucleotide
accggactcctcgaggagtccggt

SEQ ID NO: 15423 - DNA, 24 bp, Artificial Sequence
  Description of Artificial Sequence: Synthetic oligonucleotide
tccggactcctcgaggagtccgga

SEQ ID NO: 15424 - DNA, 24 bp, Artificial Sequence
  Description of Artificial Sequence: Synthetic oligonucleotide
gcccgactcggtaccgagtcgggc

SEQ ID NO: 15425 - DNA, 24 bp, Artificial Sequence
  Description of Artificial Sequence: Synthetic oligonucleotide
gggcgactcggtaccgagtcgccc

SEQ ID NO: 15426 - DNA, 24 bp, Artificial Sequence
  Description of Artificial Sequence: Synthetic oligonucleotide
gggagactcggtaccgagtctccc

SEQ ID NO: 15427 - DNA, 24 bp, Artificial Sequence
  Description of Artificial Sequence: Synthetic oligonucleotide
gggtgactcggtaccgagtcaccc

SEQ ID NO: 15428 - DNA, 24 bp, Artificial Sequence
  Description of Artificial Sequence: Synthetic oligonucleotide
ggacgactcggtaccgagtcgtcc

SEQ ID NO: 15429 - DNA, 24 bp, Artificial Sequence
  Description of Artificial Sequence: Synthetic oligonucleotide
gcacgactcggtaccgagtcgtgc

SEQ ID NO: 15430 - DNA, 24 bp, Artificial Sequence
  Description of Artificial Sequence: Synthetic oligonucleotide
gaccgactcggtaccgagtcggtc

SEQ ID NO: 15431 - DNA, 24 bp, Artificial Sequence
  Description of Artificial Sequence: Synthetic oligonucleotide
gtccgactcggtaccgagtcggac

SEQ ID NO: 15432 - DNA, 24 bp, Artificial Sequence
  Description of Artificial Sequence: Synthetic oligonucleotide
acccgactcggtaccgagtcgggt

SEQ ID NO: 15433 - DNA, 24 bp, Artificial Sequence
  Description of Artificial Sequence: Synthetic oligonucleotide
tcccgactcggtaccgagtcggga

SEQ ID NO: 15434 - DNA, 24 bp, Artificial Sequence
  Description of Artificial Sequence: Synthetic oligonucleotide
gccagactcggtaccgagtctggc

SEQ ID NO: 15435 - DNA, 24 bp, Artificial Sequence
  Description of Artificial Sequence: Synthetic oligonucleotide
gcctgactcggtaccgagtcaggc

SEQ ID NO: 15436 - DNA, 24 bp, Artificial Sequence
  Description of Artificial Sequence: Synthetic oligonucleotide
gacggactcggtaccgagtccgtc

SEQ ID NO: 15437 - DNA, 24 bp, Artificial Sequence
  Description of Artificial Sequence: Synthetic oligonucleotide
gtcggactcggtaccgagtccgac

SEQ ID NO: 15438 - DNA, 24 bp, Artificial Sequence
  Description of Artificial Sequence: Synthetic oligonucleotide
agcggactcggtaccgagtccgct

SEQ ID NO: 15439 - DNA, 24 bp, Artificial Sequence
  Description of Artificial Sequence: Synthetic oligonucleotide
tgcggactcggtaccgagtccgca

SEQ ID NO: 15440 - DNA, 24 bp, Artificial Sequence
  Description of Artificial Sequence: Synthetic oligonucleotide
ggaggactcggtaccgagtcctcc

SEQ ID NO: 15441 - DNA, 24 bp, Artificial Sequence
  Description of Artificial Sequence: Synthetic oligonucleotide
ggtggactcggtaccgagtccacc

SEQ ID NO: 15442 - DNA, 24 bp, Artificial Sequence
  Description of Artificial Sequence: Synthetic oligonucleotide
ggcagactcggtaccgagtctgcc

SEQ ID NO: 15443 - DNA, 24 bp, Artificial Sequence
  Description of Artificial Sequence: Synthetic oligonucleotide
ggctgactcggtaccgagtcagcc

SEQ ID NO: 15444 - DNA, 24 bp, Artificial Sequence
  Description of Artificial Sequence: Synthetic oligonucleotide
cacggactcggtaccgagtccgtg

SEQ ID NO: 15445 - DNA, 24 bp, Artificial Sequence
  Description of Artificial Sequence: Synthetic oligonucleotide
ctcggactcggtaccgagtccgag

SEQ ID NO: 15446 - DNA, 24 bp, Artificial Sequence
  Description of Artificial Sequence: Synthetic oligonucleotide
ccaggactcggtaccgagtcctgg

SEQ ID NO: 15447 - DNA, 24 bp, Artificial Sequence
  Description of Artificial Sequence: Synthetic oligonucleotide
cctggactcggtaccgagtccagg

SEQ ID NO: 15448 - DNA, 24 bp, Artificial Sequence
  Description of Artificial Sequence: Synthetic oligonucleotide
cccagactcggtaccgagtctggg

SEQ ID NO: 15449 - DNA, 24 bp, Artificial Sequence
  Description of Artificial Sequence: Synthetic oligonucleotide
ccctgactcggtaccgagtcaggg

SEQ ID NO: 15450 - DNA, 24 bp, Artificial Sequence
  Description of Artificial Sequence: Synthetic oligonucleotide
acgggactcggtaccgagtcccgt

SEQ ID NO: 15451 - DNA, 24 bp, Artificial Sequence
  Description of Artificial Sequence: Synthetic oligonucleotide
tcgggactcggtaccgagtcccga

SEQ ID NO: 15452 - DNA, 24 bp, Artificial Sequence
  Description of Artificial Sequence: Synthetic oligonucleotide
cagggactcggtaccgagtccctg

SEQ ID NO: 15453 - DNA, 24 bp, Artificial Sequence
  Description of Artificial Sequence: Synthetic oligonucleotide
ctgggactcggtaccgagtcccag

SEQ ID NO: 15454 - DNA, 24 bp, Artificial Sequence
  Description of Artificial Sequence: Synthetic oligonucleotide
ccgggactccacgtggagtcccgg

SEQ ID NO: 15455 - DNA, 24 bp, Artificial Sequence
  Description of Artificial Sequence: Synthetic oligonucleotide
cccggactccacgtggagtccggg

SEQ ID NO: 15456 - DNA, 24 bp, Artificial Sequence
  Description of Artificial Sequence: Synthetic oligonucleotide
gccggactccacgtggagtccggc

SEQ ID NO: 15457 - DNA, 24 bp, Artificial Sequence
  Description of Artificial Sequence: Synthetic oligonucleotide
ggccgactccacgtggagtcggcc

SEQ ID NO: 15458 - DNA, 24 bp, Artificial Sequence
  Description of Artificial Sequence: Synthetic oligonucleotide
ggtcgactccacgtggagtcgacc

SEQ ID NO: 15459 - DNA, 24 bp, Artificial Sequence
  Description of Artificial Sequence: Synthetic oligonucleotide
gctcgactccacgtggagtcgagc

SEQ ID NO: 15460 - DNA, 24 bp, Artificial Sequence
  Description of Artificial Sequence: Synthetic oligonucleotide
accggactccacgtggagtccggt

SEQ ID NO: 15461 - DNA, 24 bp, Artificial Sequence
  Description of Artificial Sequence: Synthetic oligonucleotide
tccggactccacgtggagtccgga

SEQ ID NO: 15462 - DNA, 24 bp, Artificial Sequence
  Description of Artificial Sequence: Synthetic oligonucleotide
gcccgactcggatccgagtcgggc

SEQ ID NO: 15463 - DNA, 24 bp, Artificial Sequence
  Description of Artificial Sequence: Synthetic oligonucleotide
gggcgactcggatccgagtcgccc

SEQ ID NO: 15464 - DNA, 24 bp, Artificial Sequence
  Description of Artificial Sequence: Synthetic oligonucleotide
gggagactcggatccgagtctccc

SEQ ID NO: 15465 - DNA, 24 bp, Artificial Sequence
  Description of Artificial Sequence: Synthetic oligonucleotide
gggtgactcggatccgagtcaccc

SEQ ID NO: 15466 - DNA, 24 bp, Artificial Sequence
  Description of Artificial Sequence: Synthetic oligonucleotide
ggacgactcggatccgagtcgtcc

SEQ ID NO: 15467 - DNA, 24 bp, Artificial Sequence
  Description of Artificial Sequence: Synthetic oligonucleotide
gcacgactcggatccgagtcgtgc

SEQ ID NO: 15468 - DNA, 24 bp, Artificial Sequence
  Description of Artificial Sequence: Synthetic oligonucleotide
gaccgactcggatccgagtcggtc

SEQ ID NO: 15469 - DNA, 24 bp, Artificial Sequence
  Description of Artificial Sequence: Synthetic oligonucleotide
gtccgactcggatccgagtcggac

SEQ ID NO: 15470 - DNA, 24 bp, Artificial Sequence
  Description of Artificial Sequence: Synthetic oligonucleotide
acccgactcggatccgagtcgggt

SEQ ID NO: 15471 - DNA, 24 bp, Artificial Sequence
  Description of Artificial Sequence: Synthetic oligonucleotide
tcccgactcggatccgagtcggga

SEQ ID NO: 15472 - DNA, 24 bp, Artificial Sequence
  Description of Artificial Sequence: Synthetic oligonucleotide
gccagactcggatccgagtctggc

SEQ ID NO: 15473 - DNA, 24 bp, Artificial Sequence
  Description of Artificial Sequence: Synthetic oligonucleotide
gcctgactcggatccgagtcaggc

SEQ ID NO: 15474 - DNA, 24 bp, Artificial Sequence
  Description of Artificial Sequence: Synthetic oligonucleotide
gacggactcggatccgagtccgtc

SEQ ID NO: 15475 - DNA, 24 bp, Artificial Sequence
  Description of Artificial Sequence: Synthetic oligonucleotide
gtcggactcggatccgagtccgac

SEQ ID NO: 15476 - DNA, 24 bp, Artificial Sequence
  Description of Artificial Sequence: Synthetic oligonucleotide
agcggactcggatccgagtccgct

SEQ ID NO: 15477 - DNA, 24 bp, Artificial Sequence
  Description of Artificial Sequence: Synthetic oligonucleotide
tgcggactcggatccgagtccgca

SEQ ID NO: 15478 - DNA, 24 bp, Artificial Sequence
  Description of Artificial Sequence: Synthetic oligonucleotide
ggaggactcggatccgagtcctcc

SEQ ID NO: 15479 - DNA, 24 bp, Artificial Sequence
  Description of Artificial Sequence: Synthetic oligonucleotide
ggtggactcggatccgagtccacc

SEQ ID NO: 15480 - DNA, 24 bp, Artificial Sequence
  Description of Artificial Sequence: Synthetic oligonucleotide
ggcagactcggatccgagtctgcc

SEQ ID NO: 15481 - DNA, 24 bp, Artificial Sequence
  Description of Artificial Sequence: Synthetic oligonucleotide
ggctgactcggatccgagtcagcc

SEQ ID NO: 15482 - DNA, 24 bp, Artificial Sequence
  Description of Artificial Sequence: Synthetic oligonucleotide
cacggactcggatccgagtccgtg

SEQ ID NO: 15483 - DNA, 24 bp, Artificial Sequence
  Description of Artificial Sequence: Synthetic oligonucleotide
ctcggactcggatccgagtccgag

SEQ ID NO: 15484 - DNA, 24 bp, Artificial Sequence
  Description of Artificial Sequence: Synthetic oligonucleotide
ccaggactcggatccgagtcctgg

SEQ ID NO: 15485 - DNA, 24 bp, Artificial Sequence
  Description of Artificial Sequence: Synthetic oligonucleotide
cctggactcggatccgagtccagg

SEQ ID NO: 15486 - DNA, 24 bp, Artificial Sequence
  Description of Artificial Sequence: Synthetic oligonucleotide
cccagactcggatccgagtctggg

SEQ ID NO: 15487 - DNA, 24 bp, Artificial Sequence
  Description of Artificial Sequence: Synthetic oligonucleotide
ccctgactcggatccgagtcaggg

SEQ ID NO: 15488 - DNA, 24 bp, Artificial Sequence
  Description of Artificial Sequence: Synthetic oligonucleotide
acgggactcggatccgagtcccgt

SEQ ID NO: 15489 - DNA, 24 bp, Artificial Sequence
  Description of Artificial Sequence: Synthetic oligonucleotide
tcgggactcggatccgagtcccga

SEQ ID NO: 15490 - DNA, 24 bp, Artificial Sequence
  Description of Artificial Sequence: Synthetic oligonucleotide
cagggactcggatccgagtccctg

SEQ ID NO: 15491 - DNA, 24 bp, Artificial Sequence
  Description of Artificial Sequence: Synthetic oligonucleotide
ctgggactcggatccgagtcccag

SEQ ID NO: 15492 - DNA, 24 bp, Artificial Sequence
  Description of Artificial Sequence: Synthetic oligonucleotide
ccgggactccgtacggagtcccgg

SEQ ID NO: 15493 - DNA, 24 bp, Artificial Sequence
  Description of Artificial Sequence: Synthetic oligonucleotide
cccggactccgtacggagtccggg

SEQ ID NO: 15494 - DNA, 24 bp, Artificial Sequence
  Description of Artificial Sequence: Synthetic oligonucleotide
gccggactccgtacggagtccggc

SEQ ID NO: 15495 - DNA, 24 bp, Artificial Sequence
  Description of Artificial Sequence: Synthetic oligonucleotide
ggccgactccgtacggagtcggcc

SEQ ID NO: 15496 - DNA, 24 bp, Artificial Sequence
  Description of Artificial Sequence: Synthetic oligonucleotide
ggtcgactccgtacggagtcgacc

SEQ ID NO: 15497 - DNA, 24 bp, Artificial Sequence
  Description of Artificial Sequence: Synthetic oligonucleotide
gctcgactccgtacggagtcgagc

SEQ ID NO: 15498 - DNA, 24 bp, Artificial Sequence
  Description of Artificial Sequence: Synthetic oligonucleotide
accggactccgtacggagtccggt

SEQ ID NO: 15499 - DNA, 24 bp, Artificial Sequence
  Description of Artificial Sequence: Synthetic oligonucleotide
tccggactccgtacggagtccgga

SEQ ID NO: 15500 - DNA, 24 bp, Artificial Sequence
  Description of Artificial Sequence: Synthetic oligonucleotide
ccgggactccgatcggagtcccgg

SEQ ID NO: 15501 - DNA, 24 bp, Artificial Sequence
  Description of Artificial Sequence: Synthetic oligonucleotide
cccggactccgatcggagtccggg

SEQ ID NO: 15502 - DNA, 24 bp, Artificial Sequence
  Description of Artificial Sequence: Synthetic oligonucleotide
gccggactccgatcggagtccggc

SEQ ID NO: 15503 - DNA, 24 bp, Artificial Sequence
  Description of Artificial Sequence: Synthetic oligonucleotide
ggccgactccgatcggagtcggcc

SEQ ID NO: 15504 - DNA, 24 bp, Artificial Sequence
  Description of Artificial Sequence: Synthetic oligonucleotide
ggtcgactccgatcggagtcgacc

SEQ ID NO: 15505 - DNA, 24 bp, Artificial Sequence
  Description of Artificial Sequence: Synthetic oligonucleotide
gctcgactccgatcggagtcgagc

SEQ ID NO: 15506 - DNA, 24 bp, Artificial Sequence
  Description of Artificial Sequence: Synthetic oligonucleotide
accggactccgatcggagtccggt

SEQ ID NO: 15507 - DNA, 24 bp, Artificial Sequence
  Description of Artificial Sequence: Synthetic oligonucleotide
tccggactccgatcggagtccgga

SEQ ID NO: 15508 - DNA, 12 bp, Artificial Sequence
  Description of Artificial Sequence: Synthetic oligonucleotide
  modified_base (6)..(12): a, c, t, or g
gagtcnnnnnnn

SEQ ID NO: 15509 - DNA, 12 bp, Artificial Sequence
  Description of Artificial Sequence: Synthetic oligonucleotide
  modified_base (1)..(7): a, c, t, or g
nnnnnnngactc

SEQ ID NO: 15510 - DNA, 12 bp, Artificial Sequence
  Description of Artificial Sequence: Synthetic oligonucleotide
  modified_base (5)..(5): a, c, t, or g
  modified_base (7)..(12): a, c, t, or g
gagtncnnnnnn

SEQ ID NO: 15511 - DNA, 10 bp, Artificial Sequence
  Description of Artificial Sequence: Synthetic oligonucleotide
  modified_base (6)..(10): a, c, t, or g
ggatcnnnnn

SEQ ID NO: 15512 - DNA, 10 bp, Artificial Sequence
  Description of Artificial Sequence: Synthetic oligonucleotide
  modified_base (1)..(5): a, c, t, or g
nnnnngatcc

SEQ ID NO: 15513 - DNA, 10 bp, Artificial Sequence
  Description of Artificial Sequence: Synthetic oligonucleotide
  modified_base (6)..(10): a, c, t, or g
gagtcnnnnn

SEQ ID NO: 15514 - DNA, 10 bp, Artificial Sequence
  Description of Artificial Sequence: Synthetic oligonucleotide
  modified_base (1)..(5): a, c, t, or g
nnnnngactc

SEQ ID NO: 15515 - DNA, 38 bp, Artificial Sequence
  Description of Artificial Sequence: Synthetic oligonucleotide
  modified_base (1)..(4): a, c, t, or g
  modified_base (10)..(15): a, c, t, or g
  modified_base (21)..(38): a, c, t, or g
  See specification as filed for detailed description of substitutions and preferred embodiments
nnnngactcnnnnnngagtcnnnnnnnnnnnnnnnnnn

SEQ ID NO: 15516 - DNA, 22 bp, Artificial Sequence
  Description of Artificial Sequence: Synthetic oligonucleotide
ccgggactccgcggagtcccgg

SEQ ID NO: 15517 - DNA, 22 bp, Artificial Sequence
  Description of Artificial Sequence: Synthetic oligonucleotide
cccggactccgcggagtccggg

SEQ ID NO: 15518 - DNA, 22 bp, Artificial Sequence
  Description of Artificial Sequence: Synthetic oligonucleotide
gccggactccgcggagtccggc

SEQ ID NO: 15519 - DNA, 22 bp, Artificial Sequence
  Description of Artificial Sequence: Synthetic oligonucleotide
ggccgactccgcggagtcggcc

SEQ ID NO: 15520 - DNA, 22 bp, Artificial Sequence
  Description of Artificial Sequence: Synthetic oligonucleotide
accggactccgcggagtccggt

SEQ ID NO: 15521 - DNA, 22 bp, Artificial Sequence
  Description of Artificial Sequence: Synthetic oligonucleotide
ccgggactctgcagagtcccgg

SEQ ID NO: 15522 - DNA, 22 bp, Artificial Sequence
  Description of Artificial Sequence: Synthetic oligonucleotide
cccggactctgcagagtccggg

SEQ ID NO: 15523 - DNA, 22 bp, Artificial Sequence
  Description of Artificial Sequence: Synthetic oligonucleotide
gccggactctgcagagtccggc

SEQ ID NO: 15524 - DNA, 22 bp, Artificial Sequence
  Description of Artificial Sequence: Synthetic oligonucleotide
ggccgactctgcagagtcggcc

SEQ ID NO: 15525 - DNA, 22 bp, Artificial Sequence
  Description of Artificial Sequence: Synthetic oligonucleotide
ccgggactcagctgagtcccgg

SEQ ID NO: 15526 - DNA, 22 bp, Artificial Sequence
  Description of Artificial Sequence: Synthetic oligonucleotide
cccggactcagctgagtccggg

SEQ ID NO: 15527 - DNA, 22 bp, Artificial Sequence
  Description of Artificial Sequence: Synthetic oligonucleotide
gccggactcagctgagtccggc

SEQ ID NO: 15528 - DNA, 22 bp, Artificial Sequence
  Description of Artificial Sequence: Synthetic oligonucleotide
ggccgactcagctgagtcggcc

SEQ ID NO: 15529 - DNA, 22 bp, Artificial Sequence
  Description of Artificial Sequence: Synthetic oligonucleotide
ccgggactcctaggagtcccgg

SEQ ID NO: 15530 - DNA, 22 bp, Artificial Sequence
  Description of Artificial Sequence: Synthetic oligonucleotide
cccggactcctaggagtccggg

SEQ ID NO: 15531 - DNA, 22 bp, Artificial Sequence
  Description of Artificial Sequence: Synthetic oligonucleotide
gccggactcctaggagtccggc

SEQ ID NO: 15532 - DNA, 22 bp, Artificial Sequence
  Description of Artificial Sequence: Synthetic oligonucleotide
ggccgactcctaggagtcggcc

SEQ ID NO: 15533 - DNA, 22 bp, Artificial Sequence
  Description of Artificial Sequence: Synthetic oligonucleotide
ccgggactccatggagtcccgg

SEQ ID NO: 15534 - DNA, 22 bp, Artificial Sequence
  Description of Artificial Sequence: Synthetic oligonucleotide
cccggactccatggagtccggg

SEQ ID NO: 15535 - DNA, 22 bp, Artificial Sequence
  Description of Artificial Sequence: Synthetic oligonucleotide
gccggactccatggagtccggc

SEQ ID NO: 15536 - DNA, 22 bp, Artificial Sequence
  Description of Artificial Sequence: Synthetic oligonucleotide
ggccgactccatggagtcggcc

SEQ ID NO: 15537 - DNA, 22 bp, Artificial Sequence
  Description of Artificial Sequence: Synthetic oligonucleotide
ccgggactcgcgcgagtcccgg

SEQ ID NO: 15538 - DNA, 22 bp, Artificial Sequence
  Description of Artificial Sequence: Synthetic oligonucleotide
cccggactcgcgcgagtccggg

SEQ ID NO: 15539 - DNA, 22 bp, Artificial Sequence
  Description of Artificial Sequence: Synthetic oligonucleotide
gccggactcgcgcgagtccggc

SEQ ID NO: 15540 - DNA, 22 bp, Artificial Sequence
  Description of Artificial Sequence: Synthetic oligonucleotide
ggccgactcgcgcgagtcggcc

SEQ ID NO: 15541 - DNA, 22 bp, Artificial Sequence
  Description of Artificial Sequence: Synthetic oligonucleotide
accggactcgcgcgagtccggt

SEQ ID NO: 15542 - DNA, 22 bp, Artificial Sequence
  Description of Artificial Sequence: Synthetic oligonucleotide
ccgggactctcgagagtcccgg

SEQ ID NO: 15543 - DNA, 22 bp, Artificial Sequence
  Description of Artificial Sequence: Synthetic oligonucleotide
cccggactctcgagagtccggg

SEQ ID NO: 15544 - DNA, 22 bp, Artificial Sequence
  Description of Artificial Sequence: Synthetic oligonucleotide
gccggactctcgagagtccggc

SEQ ID NO: 15545 - DNA, 22 bp, Artificial Sequence
  Description of Artificial Sequence: Synthetic oligonucleotide
ggccgactctcgagagtcggcc

SEQ ID NO: 15546 - DNA, 22 bp, Artificial Sequence
  Description of Artificial Sequence: Synthetic oligonucleotide
ccgggactcacgtgagtcccgg

SEQ ID NO: 15547 - DNA, 22 bp, Artificial Sequence
  Description of Artificial Sequence: Synthetic oligonucleotide
cccggactcacgtgagtccggg

SEQ ID NO: 15548 - DNA, 22 bp, Artificial Sequence
  Description of Artificial Sequence: Synthetic oligonucleotide
gccggactcacgtgagtccggc

SEQ ID NO: 15549 - DNA, 22 bp, Artificial Sequence
  Description of Artificial Sequence: Synthetic oligonucleotide
ggccgactcacgtgagtcggcc

SEQ ID NO: 15550 - DNA, 22 bp, Artificial Sequence
  Description of Artificial Sequence: Synthetic oligonucleotide
ccgggactcgtacgagtcccgg

SEQ ID NO: 15551 - DNA, 22 bp, Artificial Sequence
  Description of Artificial Sequence: Synthetic oligonucleotide
cccggactcgtacgagtccggg

SEQ ID NO: 15552 - DNA, 22 bp, Artificial Sequence
  Description of Artificial Sequence: Synthetic oligonucleotide
gccggactcgtacgagtccggc

SEQ ID NO: 15553 - DNA, 22 bp, Artificial Sequence
  Description of Artificial Sequence: Synthetic oligonucleotide
ggccgactcgtacgagtcggcc

SEQ ID NO: 15554 - DNA, 22 bp, Artificial Sequence
  Description of Artificial Sequence: Synthetic oligonucleotide
ccgggactcgatcgagtcccgg

SEQ ID NO: 15555 - DNA, 22 bp, Artificial Sequence
  Description of Artificial Sequence: Synthetic oligonucleotide
cccggactcgatcgagtccggg

SEQ ID NO: 15556 - DNA, 22 bp, Artificial Sequence
  Description of Artificial Sequence: Synthetic oligonucleotide
ggcggactcgatcgagtccgcc

SEQ ID NO: 15557 - DNA, 22 bp, Artificial Sequence
  Description of Artificial Sequence: Synthetic oligonucleotide
gccggactcgatcgagtccggc

SEQ ID NO: 15558 - DNA, 22 bp, Artificial Sequence
  Description of Artificial Sequence: Synthetic oligonucleotide
gcccgactcgatcgagtcgggc

SEQ ID NO: 15559 - DNA, 22 bp, Artificial Sequence
  Description of Artificial Sequence: Synthetic oligonucleotide
ggccgactcgatcgagtcggcc

SEQ ID NO: 15560 - DNA, 22 bp, Artificial Sequence
  Description of Artificial Sequence: Synthetic oligonucleotide
gggcgactcgatcgagtcgccc

SEQ ID NO: 15561 - DNA, 22 bp, Artificial Sequence
  Description of Artificial Sequence: Synthetic oligonucleotide
ccgggactcggccgagtcccgg

SEQ ID NO: 15562 - DNA, 22 bp, Artificial Sequence
  Description of Artificial Sequence: Synthetic oligonucleotide
cccggactcggccgagtccggg

SEQ ID NO: 15563 - DNA, 22 bp, Artificial Sequence
  Description of Artificial Sequence: Synthetic oligonucleotide
gccggactcggccgagtccggc

SEQ ID NO: 15564 - DNA, 22 bp, Artificial Sequence
  Description of Artificial Sequence: Synthetic oligonucleotide
ggccgactcggccgagtcggcc

SEQ ID NO: 15565 - DNA, 22 bp, Artificial Sequence
  Description of Artificial Sequence: Synthetic oligonucleotide
accggactcggccgagtccggt

SEQ ID NO: 15566 - DNA, 22 bp, Artificial Sequence
  Description of Artificial Sequence: Synthetic oligonucleotide
ccgggactcccgggagtcccgg

SEQ ID NO: 15567 - DNA, 22 bp, Artificial Sequence
  Description of Artificial Sequence: Synthetic oligonucleotide
cccggactcccgggagtccggg

SEQ ID NO: 15568 - DNA, 22 bp, Artificial Sequence
  Description of Artificial Sequence: Synthetic oligonucleotide
gccggactcccgggagtccggc

SEQ ID NO: 15569 - DNA, 22 bp, Artificial Sequence
  Description of Artificial Sequence: Synthetic oligonucleotide
ggccgactcccgggagtcggcc

SEQ ID NO: 15570 - DNA, 22 bp, Artificial Sequence
  Description of Artificial Sequence: Synthetic oligonucleotide
accggactcccgggagtccggt

What is claimed is:

1. An isolated primer oligonucleotide comprising from 5' to 3',
   i) a first region comprising a self-complementary sequence comprising from 5' to 3' the reverse complement of a nicking enzyme recognition sequence, a palindromic sequence, and said nicking enzyme recognition sequence, and
   ii) a second region at least 16 nucleotides long that specifically binds to a complementary region on a target nucleic acid molecule to form a double-stranded primer-target hybrid having a ΔG that is at least 15 kcal/mol lower than the ΔG of a self-dimer comprising the second region, wherein the second region comprises at the 3' end two or more contiguous 2' modified nucleotides.

2. The isolated primer oligonucleotide of claim 1, wherein said palindromic sequence in the first region is 2, 4, or 6 nucleotides long.

3. The isolated primer oligonucleotide of claim 1, wherein the first region is 12, 13, 14, 15, 16, 17, 18, 19, 20, 21, 22, 23, or 24 nucleotides in length.

4. The isolated primer oligonucleotide of claim 1, in the form of a homodimer formed by hybridization of the self-complementary first region sequences of two primer oligonucleotide molecules.

5. The isolated primer oligonucleotide of claim 1, wherein the two or more contiguous 2' modified nucleotides has a 2' modification selected from the group consisting of 2'-O-methyl, 2'-methoxyethoxy, 2'-fluoro, 2'-hydroxyl, 2'-alkyl, 2'-allyl, 2'-O-[2-(methylamino)-2-oxoethyl], 4'-CH$_2$—O-2'-bridge, 4'-(CH$_2$)$_2$—O-2'-bridge, 2'-LNA, and 2'-O—(N-methylcarbamate) or those comprising base analogs.

6. The isolated primer oligonucleotide of claim 1, wherein the two or more contiguous 2' modified nucleotides at the 3' end comprises 3, 4, 5, or 6 more contiguous 2' modified nucleotides.

7. The isolated primer oligonucleotide of claim 1, wherein the nicking enzyme is one or more of Nt.BspD6I and Nt.BstNBI.

8. The isolated primer oligonucleotide of claim 1, wherein the recognition sequence of the nicking agent is positioned to cleave the phosphodiester bond between the first and second regions.

9. The isolated primer oligonucleotide of claim 1, having a first region comprising a nucleic acid sequence selected from the group consisting of:

```
                                              (SEQ ID NO: 15241)
5'-GACTCN₁N₁.GAGTC-3';

(SEQ ID NO: 15242)
5'-GACTCN₁N₁.GAGTCN-3';

(SEQ ID NO: 15243)
5'-N₂GACTCN₁N₁.GAGTCN₂.-3';

(SEQ ID NO: 15244)
5'-N₂GACTCN₁N₁.GAGTCN₂.N-3';

(SEQ ID NO: 15245)
5'-N₃N₂GACTCN₁N₁.GAGTCN₂.N₃.-3';

(SEQ ID NO: 15246)
5'-N₃N₂GACTCN₁N₁.GAGTCN₂.N₃.N-3';

(SEQ ID NO: 15247)
5'-N₄N₃N₂GACTCN₁N₁.GAGTCN₂.N₃.N₄.-3';

(SEQ ID NO: 15248)
5'-N₄N₃N₂GACTCN₁N₁.GAGTCN₂.N₃.N₄.N-3';

(SEQ ID NO: 15249)
5'-N₅N₄N₃N₂GACTCN₁N₁.GAGTCN₂.N₃.N₄.N₅.-3';

(SEQ ID NO: 15250)
5'-GACTCN₂N₁N₁.N₂.GAGTC-3';

(SEQ ID NO: 15251)
5'-GACTCN₂N₁N₁.N₂.GAGTCN-3';

(SEQ ID NO: 15252)
5'-N₃GACTCN₂N₁N₁.N₂.GAGTCN₃.-3';

(SEQ ID NO: 15253)
5'-N₃GACTCN₂N₁N₁.N₂.GAGTCN₃.N-3';

(SEQ ID NO: 15254)
5'-N₄N₃GACTCN₂N₁N₁.N₂.GAGTCN₃.N₄.-3';

(SEQ ID NO: 15255)
5'-N₄N₃GACTCN₂N₁N₁.N₂.GAGTCN₃.N₄.N-3';

(SEQ ID NO: 15256)
5'-N₅N₄N₃GACTCN₂N₁N₁.N₂.GAGTCN₃.N₄.N₅.-3';

(SEQ ID NO: 15257)
5'-N₅N₄N₃GACTCN₂N₁N₁.N₂.GAGTCN₃.N₄.N₅.N-3';

(SEQ ID NO: 15258)
5'-N₆N₅N₄N₃GACTCN₂N₁N₁.N₂.GAGTCN₃.N₄.N₅.N₆.-3', (SEQ ID NO: 15259)
5'-GACTCN₃N₂N₁N₁.N₂.N₃.GAGTC-3';

(SEQ ID NO: 15260)
5'-GACTCN₃N₂N₁N₁.N₂.N₃.GAGTCN-3';

(SEQ ID NO: 15261)
5'-GACTCN₃N₂N₁N₁.N₂.N₃.GAGTCNN-3';

(SEQ ID NO: 15262)
5'-GACTCN₃N₂N₁N₁.N₂.N₃.GAGTCNNN-3';
```

-continued

```
                                          (SEQ ID NO: 15263)
5'-GACTCN₃N₂N₁N₁'.N₂'.N₃'.GAGTCNNNN-3';

(SEQ ID NO: 15264)
5'-N₄GACTCN₃N₂N₁N₁'.N₂'.N₃'.GAGTCN₄'.-3';

(SEQ ID NO: 15265)
5'-N₄GACTCN₃N₂N₁N₁'.N₂'.N₃'.GAGTCN₄'.N-3';

(SEQ ID NO: 15266)
5'-N₄GACTCN₃N₂N₁N₁'.N₂'.N₃'.GAGTCN₄'.NN-3';

(SEQ ID NO: 15267)
5'-N₄GACTCN₃N₂N₁N₁'.N₂'.N₃'.GAGTCN₄'.NNN-3';

(SEQ ID NO: 15268)
5'-N₅N₄GACTCN₃N₂N₁N₁'.N₂'.N₃'.GAGTCN₄'.N₅'.-3';

(SEQ ID NO: 15269)
5'-N₅N₄GACTCN₃N₂N₁N₁'.N₂'.N₃'.GAGTCN₄'.N₅'.N-3';

(SEQ ID NO: 15270)
5'-N₆N₅N4GACTCN₃N₂N₁N₁'.N₂'.N₃'.GAGTCN₄'.N₅'.N₆'.-3';

(SEQ ID NO: 15271)
5'-N₆N₅N4GACTCN₃N₂N₁N₁'.N₂'.N₃'.GAGTCN₄'.N₅'.N₆'.N-3';
and (SEQ ID NO: 15272)
5'-N₇N₆N₅N₄GACTCN₃N₂N₁N₁'.N₂'.N₃'.GAGTCN₄'.N₅'.N₆'.N₇'.-3',
``` where N is an adenine (A), thymine (T), cytosine (C), or guanine (G) nucleobase, and Ni is complementary to $N_1'$, $N_2$ to $N_2'$, $N_3$ to $N_3'$, $N_4$ to $N_4'$, $N_5$ to $N_5'$, $N_6$ to $N_6'$, and $N_7$ to $N_7'$.

10. A method of amplifying a specific product in a nicking and extension amplification reaction, the method comprising:
(a) contacting a target nucleic acid molecule with a polymerase, two or more primers, each of which specifically binds to a complementary sequence on the target nucleic acid molecule, a nicking enzyme, and a detectable polynucleotide probe, wherein at least one primer comprises from 5' to 3',
   i) a first region comprising a self-complementary sequence comprising from 5' to 3' the reverse complement of a nicking enzyme recognition sequence, a palindromic sequence, and said nicking enzyme recognition sequence, and
   ii) a second region at least 16 nucleotides long that specifically binds to a complementary region on a target nucleic acid molecule to form a double-stranded primer-target hybrid having a ΔG that is at least 15 kcal/mol lower than the ΔG of a self-dimer comprising the second region of the primer, wherein the second region comprises at the 3' end two or more contiguous 2' modified nucleotides; and
(b) generating amplicons comprising at least a portion of said target nucleic acid molecule.

11. A method of claim 10, further comprising: (c) detecting a signal specific for oligonucleotide probe hybridization to the target nucleic acid molecule or amplicon thereof, wherein the signal indicates the presence of the target nucleic acid molecule present in the sample or an amplicon thereof.

12. The method of claim 11, wherein the oligonucleotide probe comprises:
   i) an oligonucleotide;
   ii) a fluorescent reporter; and
   iii) a quenching molecule capable of absorbing the excitation energy from the fluorescent reporter;
wherein the fluorescent reporter and quenching molecule are covalently attached to opposite 5' and 3' ends of the oligonucleotide,
wherein the oligonucleotide comprises a first region having a nucleic acid sequence that is substantially complementary to a target nucleic acid sequence and
   a) a second region 5' upstream of the first region, and
   b) a third region 3' downstream of the first region that has a nucleic acid sequence complementary to the second region,
wherein the oligonucleotide is capable of forming a stem-loop hairpin structure by hybridization of the second and third regions when the oligonucleotide is not bound to the target nucleic acid molecule.

13. The method of claim 10, wherein the polymerase is a *Geobacillus* spp. or *Bacillus stearothermophilus* DNA polymerase I, or active fragments and derivatives thereof.

14. The method of claim 10, wherein the two or more contiguous 2' modified nucleotides has a 2' modification selected from the group consisting of 2'-O-methyl, 2'-methoxyethoxy, 2'-fluoro, 2'-hydroxyl, 2'-alkyl, 2'-allyl, 2'-O-[2-(methylamino)-2-oxoethyl], 4'-thio, 4'-CH₂—O-2'-bridge, 4'-(CH₂)₂—O-2'-bridge, 2'-LNA, and 2'-O—(N-methylcarbamate) or those comprising base analogs.

15. The method of claim 10, wherein the two or more contiguous 2' modified nucleotides at the 3' end comprises 3, 4, 5, 6 or more contiguous 2' modified nucleotides.

16. A kit for amplifying a target sequence in a nicking amplification reaction, the kit comprising one or more primer oligonucleotides comprising from 5' to 3',
   i) a first region comprising a self-complementary sequence comprising from 5' to 3' the reverse complement of a nicking enzyme recognition sequence, a palindromic sequence, and said nicking enzyme recognition sequence, and
   ii) a second region at least 16 nucleotides long that specifically binds to a complementary region on a target nucleic acid molecule to form a double-stranded primer-target hybrid having a ΔG that is at least 15 kcal/mol lower than the ΔG of a self-dimer comprising the second region of the primer, wherein the second region comprises at the 3' end two or more contiguous 2' modified nucleotides;
and directions for use of the primer.

17. The kit of claim 16, further comprising an oligonucleotide probe comprising:
   i) an oligonucleotide;
   ii) a fluorescent reporter; and
   iii) a quenching molecule capable of absorbing the excitation energy from the fluorescent reporter;
wherein the fluorescent reporter and quenching molecule are covalently attached to opposite 5' and 3' ends of the oligonucleotide,
wherein the oligonucleotide comprises a first region having a nucleic acid sequence that is substantially complementary to a target nucleic acid sequence and
   a) a second region 5' upstream of the first region, and
   b) a third region 3' downstream of the first region that has a nucleic acid sequence complementary to the second region,
wherein the oligonucleotide is capable of forming a stem-loop hairpin structure by hybridization of the second and third regions when the oligonucleotide is not bound to the target nucleic acid molecule.

* * * * *